United States Patent 9,551,006 (ISOLATED POLYNUCLEOTIDES AND POLYPEPTIDES, AND METHODS OF USING SAME FOR IMPROVING PLANT PROPERTIES) - sequence listing, part 4

SEQ ID NO: 5875 - protein, 380 aa, Eucalyptus grandis
MASTAGQVIRCKAAVAWEAGKPLVIEEVEVAPPQAMEVRIKILFTSLCHTDVFFWEAKGQTPLFPRIFGHEASGIVESVGEGVTELEPGDHVLPVFTGECKECQHCKSEESNMCGLLRINTDRGVMLNDNESRFSINGKPIYHFVGTSTFSEYTVVHVGCVAKINPAAPMDKVCVLSCGISTGLGATLNVAKPKKGQSVAIFGLGTVGLAAAEGARMAGASRIIGVDRNPNRFVEAKKFGVNEFVNPKDHNKPVQEVIAEMTDGGVDRSLECTGNIDAMISAFECVHDGWGIAVLVGVPSKDDVFKTHPMNLLNERTLKGTFFGNYKPRTDLPSVVEKYMNKELDVEKFITHEVPFSEINKAFDYMLQGTSLRCIIRMGA

SEQ ID NO: 5876 - protein, 380 aa, Trigonella foenum-graecum
MSNTAGQVIKCRAAVAWEAGKPLVMEEVEVAPPQAGEVRLKILFTSLCHTDVYFWEAKGQTPLFPRIFGHEAGGIVESVGEGVTNLKPGDHALPVFTGECGECPHCNSEESNMCDLLRINTDRGVMISDNKSRFSIKGQPIHHFVGTSTFSEYTVVHAGCVAKINPDAPLDKVCILSCGICTGLGATVNVAKPKPGSSVAIFGLGAVGLAAAEGARISGASRIIGVDLVSSRFELAKKFGVNEFVNPKDHNKPVQEVIAEMTNGGVDRAVECTGSIQAMISAFECVHDGWGVAVLVGVPNKDDAFKTHPMNLLNERTLKGTFYGNYKPRTDLPNVVEKYMKGELELEKFITHSIPFSEINKAFDYMLKGESIRCIIRMEE

SEQ ID NO: 5877 - protein, 380 aa, Vinca minor
MSSTAGQVIKCKAAVAWEAGKPLVIEEIEVAPPQKHEVRVKIMFTSLCHTDVYFWEAKGQTPLFPRIFGHEAGGIVESVGEGVTTLKPGDHVLPIFTGECGECRHCKSTESNMCDLLRINTDRGEMLHDGKSRFSKDGKPIYHFVGTSTFSEYTVLHFGSLAKINPDAPLDKVCVLSCGISTGLGATLNVAKPTKGSTVAIFGLGAVGLAAAEGARIAGASRIIGIDLNPNRFTDAKKFGVNEFVNPKDHTKPIQQVICEMTDGGVDRSVECTGNVNAMISAFECVHDGWGVAVLVGVPNKDDAFKTHPMNLLNERTLKGTFFGNYKPRSDIPNVVEKYMKKELEVEKFITHHIPFSEINKAFDLMLKGEGIRCIIRMDG

SEQ ID NO: 5878 - protein, 379 aa, Petunia hybrida
MSSTVGQVIRCKAAVAWQPGKPLVIEEVEVAPPQKMEVRLKILYTSLCHTDVYFWEAKGQNPVFPRILGHEAAGIVESVGEGVTELVPGDHVLPVFTGECKDCAHCKSEESNMCSLLRINTDRGVMIHDGQSRFSINGKPIFHFVGTSTFSEYTVVHVGCLAKINPLAPLDKVCVLSCGISTGLGATLVAKPTKGSSVAIFGLGAVGLAAAEGARIAGASRIIDVDLNASRFEEAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDLPSVVEKYMNKELELEKFITHKLPFAQINKAFDLMLKGEGLRCIINMED

SEQ ID NO: 5879 - protein, 379 aa, Prunus persica
MSTAGQVIKCRAAVAWEAGKPLSIEEVEVAPPQKEEVRLKILFTSLCHTDVYFWEAKGQHPLFPRIYGHEAGGIVESVGEGVTDLQPGDHVLPVFTGECKECRHCKSEESNMCDLLRINTDRGTMLSDGKSRFSKDGKPIYHFLGTSTFSEYTVCHVGSVAKINPAAPLEKVCVLSCGICTGFGATVNVAKPKKGSSVAIFGLGAVGLAAAEGARVSGAARIIGVDLNSNRFEEAKKFGVNEFVNPKDHNKPVQEVIAEMTDGGVDRSVECTGSVQAMISAFECVHDGWGVAVLVGVPSKDDAFKTHPVNFLNERTLKGTFYGNYKPRSDLPGVVEMYMNKELEVDKFITHSVPFAEINKAFDLMLSGQSIRCIIRMED

SEQ ID NO: 5880 - protein, 380 aa, Fragaria vesca
MFDTAGKVIKCKAAVAWEAGKPLVIEEVEVAPPQKHEVRLKILFTALCHTDVYFWEAKGQNPLFPRILGHEAGGIVESVGEGVTELQPGDHVLPVFTGECKECTHCKSEESNMCDLLRINTDRGTMLSDGKTRFSKDGKPIYHFVGTSTFSEYTVSHVGSIAKINPAAPLDKVCVLSCGICTGFGATVNVAKPKKGSSVAIFGLGAVGLAAAEGARVSGASRIIGVDLNSNRFEEAKKFGVNEFVNPKDHKKPVQEVIAEMTNGGVDRSVECTGSIQAMISAFECVHDGWGVAVLVGVPNKDDAFKTHPMNFLNERTLKGTFYGNYKPRTDLPGVVEKYMNKELELDKFITHSVPFSEINKAFDYMLAGEGIRCIIRMEH

SEQ ID NO: 5881 - protein, 68 aa, Ananas comosus
MRYLRPPPVNFLNEKTLKGTFFGNYKPRSDLPSVVEKYMNKELELEKFITHTVSFSEINKGVRVHAQR

SEQ ID NO: 5882 - protein, 309 aa, Helianthus annuus
MSTTTGQVIRCKAAVAWEAGKPLVIEEVEVAPPQKMEVRIKILFTSLCHTDVYFWEAKGQNPVFPRILGHEAGGVVESVGEGVTDLEPGDHVLPVFTGECKECAHCKSEESNMCDLLRINTDRGVMLHDQKSRFSINGNPIFHFVGTSTFSEYTVVHVGCLAKINPHAPLDKVCVLSCGISTGLGATLNVAKPKKGSSVAVFGLGAVGLAAAEGARISGASRIIGVDLNASRFELAKKFGVTEFVNPKDYKKPVQEVIAEMTNGGVDRSVECTGHVDAMISAFECVHDGWGVAVLVGVPHKDAVFKTNP

SEQ ID NO: 5883 - protein, 289 aa, Helianthus annuus
MFFLFSQENAKSAHCKSEESNMCDLLRIKTDRGVMLHDQKSRFSINGKPVFHFVGTSTLSEYTVTHVGCLAKINPLAPLDKVCVLSCGISTGLGATLNVAKPKKGSSVAVFGLGAVGLAAAEGARISGASRIIGVDLNANRFELAKKFGVTEFVNPKDYKKPVQEVIAEMTNGGVDRSVECTGHVDAMISAFECVHDGWGVAVLVGVPHKDAVFKTSPMNLLNERTLKGTFFGNYKPRSDIPSVVEKYMNKELELEKFITHEVPFSEINKAFDLMLKGEGLRCIIRMDA

SEQ ID NO: 5884 - protein, 381 aa, Ipomoea batatas
MAANTAGQVIRCKAAVAWEAGKPLVIEEVEVAPPQKMEVRLKILYTSLCHTDVYFWEAKGQTPLFPRIFGHEAGGIVESVGEGVTHLQPGDHALPVFTGECGDCRHCKSEESNMCDLLRINTDRGVMIEDGNTRFSKDGKPIYHFVGTSTFSEYTTLHAGCVAKINPEAPLDKVCVLSCGISTGFGATVNVAKPTKGSTVAIFGLGAVGLAAAEGARLSGASRIIGVDLNANRFEDAKKFGVNEFVNPKDHSKPVQEVIAEMTDGGVDRSVECTGNINAMISAFECVHDGWGVAVLVGVPNKDDAFKTHPVNLLNERTLKGTFFGNYKPRSDLPAVVEKYMKKELELEKFITHQVSFSEINKAFDLMLKGESLRCIIKMEH

SEQ ID NO: 5885 - protein, 240 aa, Fragaria vesca
MFDTAGKVIKCKAAVAWEAGKPLVIEEVEVAPPQKHEVRLKILFTALCHTDVYFWEAKGQNPLFPRILGHEAGGIVESVGEGVTELQPGDHVLPVFTGECKECTHCKSEESNMCDLLRINTDRGTMLSDGKTRFSKDGKPIYHFVGTSTFSEYTVSHVGSIAKINPAAPLDKVCVLSCGICTGFGATVNVAKPKKGSSVAIFGLGAVGLAAAEGARVSGLQGSLELISTPTDLRKPRSLG

SEQ ID NO: 5886 - protein, 268 aa, Nicotiana tabacum
MCDLLRINTDRGVMIHDGQTRFSKDGKPIYHFVGTSTFSEYTVVHSGCVAKIDPQAPLDKVCVLSCGISTGLGATLNVAKPTKGSTVAIFGLGAVGLAAAEGARIAGASRIIGIDLNPSRFNDAKKFGVTEFVNPKDYDKPVQQVIAEMTDGGVDRSVECTGNVNAMISAFECVHDGWGVAVLVGVPNKDDAFKTHPMNLLNERTLKGTFFGNYKPKTDLPSVVGKYMNKELELEKFITHQVPFSEINKAFEYMLKGEGLRCMITMGH

SEQ ID NO: 5887 - protein, 380 aa, Thalictrum flavum
MSSTAGQVIRCRAAVAWEAGKPLVIEQVEVAPPQAMEVRLKILFTSLCHTDVYFWEAKGQTPVFPRILGHEAGGIVESVGEGVTDLKPGDHVLPVFTGECKECAHCKSEESNMCDLLRINTDRGVMIGDGQSRFSINGKPIYHFVGTSTFSEYTVCHVGSVAKINPLAPLDKVCILSCGITTGLGAALNVAQPKKGSTVAIFGLGAVGLGAAEGARIAGASRIIGIDMNPKRFIEAKKFGITEFVNPKDHDKPVQEVLAEMTDGGVDRSIECTGHVSAMISAFECVHDGWGVAVLVGVPNKDDVFKTHPMNFLNERTLKGTFFGNYKPKSDLPSVVEMYMNKELELEKFITHEVSLSDINKAFDYMLGGDGLRCIIRMDT

SEQ ID NO: 5888 - protein, 380 aa, Fragaria vesca
MSSTEGKVICCRAAVAWEAGKPLVIEEVEVAPPQANEVRVKILYTSLCHTDVYFWEAKGQNPLFPRIYGHEAGGIVESVGEGVTDLKAGDHVLPVFTGECKECDHCKSEESNMCDLLRINTDRGVMLSDGESRFSIKGKPIYHFVGTSTFSEYTVTHVGCLAKINPKAPLDKVCVLSCGISTGLGATLNVAKPKKGSTVAVFGLGAVGLAAAEGARMAGASRIIGVDLTSNRFEEAKKFGITEFVNPKDHKKPVQEVIAELTNGGVDRSIECTGNIQSIISAFESVHDGWGVAVLVGLPPKDAVFTTHPMNFLNERTLKGTFFGNYKPRTDIPSVVEKYMNKELELDKFITHQLPFSQINKAFDYMLKGEGIRCIITMEE

SEQ ID NO: 5889 - protein, 379 aa, Prunus persica
MSTAGQVIKCRAAVAWEAGKPLSIEEVEVAPPQKEEVRLKILFTSLCHTDVYFWEAKGQHPLFPRIYGHEAGGIVESVGEGVTDLQPGDHVLPVFTGECKECRHCKSEESNMCDLLRINTDRGTMLSDGKSRFSKDGKPIYHFLGTSTFSEYTVCHVGSVAKINPAAPLEKVCVLSCGICTGFGATVNVAKPKKGSSVAIFGLGAVGLAAAEGARVSGAARIIGVDLNSNRFEEAKKFGVNEFVNPKDHNKPVQEVIAEMTDGGVDRSVECTGSVQAMISAFECVHDGWGIAVLVGVPNKDDAFKTHPVNFLNERTLKGTFYGNYKPRSDLPGVVEMYMNKELEVDKFITHSVPFAEINKAFDLMLSGQSIRCIIRMED

SEQ ID NO: 5890 - protein, 379 aa, Solanum lycopersicum
MNTAGQVIRCKAAVAWEAGKPLVIEEVDVAPPQKHEVRLKILFTSLCHTDVYFWEAKGQTPLFPRIFGHEAGGIVESVGEGVTDLQPGDHVLPVFTGECQQCRHCKSSESNMCELLRINTDRGVMISDGQTRFSKDGKPIYHFVGTSTFSEYTVAHSGCVTKIDPQAPLDKVCVLSCGISTGLGATLNVAKPTRGSYVAIFGLGAVGLAAAEGARLAGASRIIGIDLNPSRFNDAKKFGVTEFVNPKDHDKPVQEVIAEMTNGGVDRSVECTGNVNAMISAFECVHDGWGVAVLVGVPNKDDAFKTHPMNLLNERTLKGTFFGNYKPKTDLPSVVAKYMNKELELEKFITHQVPFSEINKAFDIMLKGEGLRCMITMGR

SEQ ID NO: 5891 - protein, 379 aa, Theobroma cacao
MSSTASQVIRCKAAVAWESGKPLVIQEVEVAPPQASEVRLKILFTSLCHTDVYFWEAKGQNPLFPRIYGHEAGGIVESVGECVTELKPGDHVLPVFTGECMDCAHCKSEESNMCDLLRVNTDRGVMLNDEKTRFSINGKPIYHFVGTSTFSEYTVVHAGCVAKINPLASLDKVCVLSCGISTGLGATLNVAKPPKGSTVAVFGLGAVGLAAAEGARIAGASRIIGVDINSNRFEGAKKFGVTEFVNPKDYKKPVQEVIAEITDGGVDRSIECTGNVDAMISAFECVHDGWGVAVLVGVPHKDAVFKTHPINLLNERTLKGTFFGNYKPRSDLPSVVEKYMSKELELEKFITHSVPFSEINKAFEYMLKGEGLRCIIRME

SEQ ID NO: 5892 - protein, 380 aa, Humulus lupulus
MSSTAGQVIKCRAAVAWEAGKPLVIEEVEVAPPQANEVRLKILFTALCHTDVYFWEAKGQTPVFPRIFGHEAGGIVESVGEGVTELQPGDHVLPVFTGECGDCRHCKSPESNMCDLLRINTDRGVMLNDGKTRFSKNGQPIYHFVGTSTFSEYTVVHSGCVAKINPAAPLDKVCVLSCGICTGLGATLNVAKPAKGSTVAIFGLGAVGLAAAEGARMAGAARIIGVDLNSNRFEEAKKFGVNEFVNPKDHSKPVQEVIAEMTDGGVDRSVECTGSVQAMISAFECVHDGWGVAVLVGVPNKDDAFKTHPVNFLNERTLKGTFYGNYKPRSDLPGVVEQYMNKELDIEKFITHTVPFSEINKAFEYMLKGESIRCIIRMEE

SEQ ID NO: 5893 - protein, 380 aa, Zostera marina
MASTAGKVIKCKAAVAWEAGKPLVMEEVDVAPPQKDEVRVKIKFTALCHTDVFFWEAKGQTPVFPRIFGHEAGGIVESVGEGVTDVVPGDHVLPVFTGECKECRHCKSEESNMCDLLRINTDRGVMLADGKSRFSIKGKPIYHFVGTSTFSEYTIVHVGCLAKINPEAPLDKVCILSCGISTGFGATVNVAKPTKGSSVAVFGLGAVGLSACEGARVSGAARIIGIDINPDRFEEARKFGCTDFVNPKGHTKPVQEVIAEMTDGGVDRCLECTGNINAMISAFECVHDGWGVAVLVGVPQKDAVFKTHPLQFLSEKTLKGTFYGNYKPRTDIPRVVDLYMNKGLELEKFITHEVAFADINKAFDLMLSGQGIRCIIRMDD

SEQ ID NO: 5894 - protein, 221 aa, Malus domestica
MSNTAQVIRCRAAVAWEAGKPLVIEEVEVAPPQANEVRIKILFTSLCHTDVYFWEAKGQNPLFPRIYGHEAGGIVESVGEGVTDLKAGDHVLPVFTGECKDCAHCKSEESNMCDLLRINTDRGVMLSDGKSRFSIKGKPIYHFVGTSTFSEYTVVHVGCLAKINPSAPLDKVCVLSCGISTGLGATLNVAKPKKGSTVAVFGLGAVGLAAAEEPGCLVLQE

SEQ ID NO: 5895 - protein, 379 aa, Triticum aestivum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCRSEESNLCDLLRINVDRGVMIGDGQSRFTIDGKPIFHFVGTSTFSEYTVIHVGCLAKIDPEAPLDKVCLLSCGISTGLGATLNVAKPKKGMTVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTGLPGVVDMYMRKELELDKFITHSVPFSQINTAFDLMLKGEGLRCVIRMEE

SEQ ID NO: 5896 - protein, 379 aa, Triticum aestivum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMIGDGQSRFTIDGKPIFHFVGTSTFSEYTVIHVGCLAKIDPEAPLDKVCLLSCGISTGLGATLNVAKPKKGMTVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTDLPGVVDMYMRKELELDKFITHSVPFSQINTAFDLMLKGEGLRCVIRMDE

SEQ ID NO: 5897 - protein, 383 aa, Aquilegia formosa
MASISNTTGQIIRCKAAVAWEAGKPLVIEEVEVAPPQAMEVRVKILFTSLCHTDVYFWEAKGQTPLFPRIFGHEAGGIVESVGSGVTDLKPGDHVLPVFTGECKDCAHCKSEESNMCDLLRINTDRGVMLNDGQSRFSINGKPIYHFVGTSTFSEYTVVHVGCLAKINPAAPLDKVCILSCGISTGLGAALNVAKPKQGSTVAVFGLGAVGLAACEGARIAGAKRIIGVDLNSNRFNEAKNFGVTDFVNPKDHNKPVQEVLAEMTDGGVDRSIECTGSVAAMISAFECVHDGWGVAVLVGVPNKDDAFKTHPMNLLNERTLKGTFFGNYKPRSDIPSVVEKYMNKELELEKFITHEVPFSEINKAFEYMLQGKSIRCIIRMEA

SEQ ID NO: 5898 - protein, 379 aa, Theobroma cacao
MTTAGQVIRCKAAVAWESGKPLSIEDVEVAPPQKDEVRIKILFTSLCHTDVYFWDAKGQDPLFPRILGHEAGGIVESVGEGVTDLQPGDHVLPIFTGECKECRHCLSEESNMCDLLRINTDRGTMIHDGKSRFSINGKPIYHFLGTSTFSEYTVVHVGQVAKINPSAPLDKVCVLSCGISTGFGATVNVAKPKNGQSVAVFGLGAVGLAAAEGARVSGASRIIGVDLNPNRFEEAKKFGVTEFVNPKDHNKPVQEVIAEMTGGGVDRSVECTGSIQAMISAFECVHDGWGVAVLVGVPNKDDAFKTHPMNLLNERTLKGTFFGNYKPRSHIPGVVEKYMNNELELDKFITHSVPFSEINKAFEYMLRGEGLRCIIRMDA

SEQ ID NO: 5899 - protein, 379 aa, Gossypium hirsutum
MSTAGQVIRCKAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFSINGKPIYHFLGTSTFSEYTVVHVGQVAKINPEAPLDKVCVLSCGMSTGFGATVNVAKPKKGQSVAIFGLGAVGLAAAEGARVSGASRIIGVDLNPSRFELAKNFGVTEFVNPKDHNKPVQEVIAEMTGGGVDRSVECTGSIQAMISAFECVHDGWGVAVLVGVPNKDDAFKTHPVNLLNERTLKGTFFGNYKPRTDIPAVVERYMNKELELDKFITHSVPFSEINKAFEYMLAGEGLRCVIRMDA

SEQ ID NO: 5900 - protein, 380 aa, Trigonella foenum-graecum
MSNTAGQVIKCRAAVAWEAGKPLVMEEVEVAPPQAGEVRLKILFTSLCHTDVYFWEAKGQTPLFPRIFGHEAGGIVESVGEGVTNLKPGDHALPVFTGECGECPHCNSEESNMCDLLRINTDRGVMISDNKSRFSIKGQPIHHFVGTSTFSEYTVVHAGCVAKINPDAPLDKVCILSCGICTGLGATINVAKPKPGSSVAIFGLGAVGLAAAEGARMSGASRIIGVDLVSSRFELAKKFGVNEFVNPKDHDKPVQQVIAEMTNGGVDRAVECTGSVQAMISAFECVHDGWGVAVLVGVPNKDDAFKTHPMNLLNERTLKGTFYGNYKPRTDLPNVVEKYMKGELELEKFITHSIPFSEINKAFDYMLKGESIRCIIRMEE

SEQ ID NO: 5901 - protein, 380 aa, Aquilegia formosa
MSSTAGQVIRCRAAVAWEAGKPLVIEKVEVAPPQAMEVRLKILFTSLCHTDVYFWEAKGQTPMFPRIFGHEAGGIVESVGEGVTDLKPGDHVLPVFTGECKECAHCKSEESNMCDLLRINTDRGVMIGDGQSRFSINGKPIYHFVGTSTFSEYTVCHIGSVAKISPLAPLDKVCILSCGITTGLGAALNVAQPKKGSTVAVFGLGAVGLGAAEGARIAGASRIIGIDMNPKRFIEAKKFGITEFVNPKDHDKPVQEVLAEMTDGGVDRSIECTGNVNAMISAFECVHDGWGVAVLVGVPNKDDVFKTHPMNLLNERTLKGTFFGNYKPKSDLPSVVEMYMNKELDLEKFITHEISLSEINKAFEYMLGGDGLRCIIRMDS

SEQ ID NO: 5902 - protein, 379 aa, Theobroma cacao
  misc_feature (41)..(41): Xaa can be any naturally occurring amino acid
MSSTASQVIRCKAAVAWESGKPLVIQEVEVAPPQASEVRLXILFTSLCHTDVYFWEAKGQNPLFPRIYGHEAGGIVESVGECVTELKPGDHVLPVFTGECMDCAHCKSEESNMCDLLRVNTDRGVMLNDEKTRFSINGKPIYHFVGTSTFSEYTVVHAGCVAKINPLASLDKVCVLSCGISTGLGATLNVAKPPKGSTVAVFGLGAVGLAAAEGARIAGASRIIGVDINSNRFEGAKKFGVTEFVNPKDYKKPVQEVIAEITDGGVDRSIECTGNVDAMISAFECVHDGWGVAVLVGVPHKDAVFKTHPINLLNERTLKGTFFGNYKPRSDLPSVVEKYMSKELELEKFITHSVPFFEINKAFEYMLKGEGLRCIIRME

SEQ ID NO: 5903 - protein, 379 aa, Populus trichocarpa
MASTGQVIRCKAAVAWEAGKPLVIEEVEVAPPQAMEVRLKILFTSLCHTDVYFWEAKGQTPLFPRIFGHEAGGIVESVGEGVTDLEPGDHVLPVFTGECKECRHCKSEESNMCDLLRINTDRGVMLSDGKSRFSIRGQPIYHFVGTSTFSEYTVIHVGCLAKINPAAPLDKVCLLSCGISTGLGATLNVAKPKPGSSVAIFGLGAVGLAAAEGARISGASRIIGVDLHSSRFDEAKKFGVTEFVNPNDHDKPVHEVIAEMTDGGVDRSVECTGSISAMISAFECVHDGWGVAVLVGVPSKDDSFKTNPMNFLSERTLKGTFFGNYKPRSDLPSVVEKYMNKELELEKFISHEVPFSEINKAFEYMLAKASLRCIIRMGA

SEQ ID NO: 5904 - protein, 380 aa, Oryza sativa
MATAGKVIKCKAAVAWEAGKPLSIEEVEVAPPQAMEVRLKILYTALCHTDVYFWEAKGQTPVFPRIFGHEAGGIVESVGEGVTELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFECVHDGWGVAVLVGVAGKDAAFKTHPTNFLNERTLRGTFFGNYKPRTDLPGVVEMYMNKELELEKFITHSVPFSEINTAFDLMLSGESLRCIIRMED

SEQ ID NO: 5905 - protein, 379 aa, Solanum phureja
MSTAGQVIRCKAAVAWEAGKPLVIEEVDVSPPQKHEVRLKILFTSLCHTDVYFWEAKGQTPLFPRIFGHEAGGIVESVGEGVTDLQPGDHVLPVFTGECQQCRHCKSSESNMCELLRINTDRGVMISDGQTRFSKDGKPIYHFVGTSTFSEYTVAHSGCVTKIDPQAPLDKVCVLSCGISTGLGATLNVAKPTRGSTVAIFGLGAVGLAAAEGARLAGASRIIGIDLNPSRFNDAKKFGVTEFVNPKDHDKPVQEVIAEMTDGGADRSVECTGNVNAMISAFECVHDGWGVAVLVGVPNKDDAFKTHPMNLLNERTLKGTFFGNYKPKTDLPSVVAKYMNKELELEKFITHQVPFSEINKAFDIMLKGEGLRCMITMGH

SEQ ID NO: 5906 - protein, 380 aa, Fagopyrum esculentum
MSATAGQVIKCKAAVAWEAGKPLSIEEVEVAPPQKDEVRVKILFTSLCHTDVYFWEAKGQTPLFPRIFGHEGAGIVESVGEGVTEIQPGDHVLPVFTGECGDCRHCKSEESNMCDLLRINTDRVVMLSDGKSRFKYNGKPIHHFLGTSTFSEYTVVHKGCLAKINPDAPLDKTCVISCGFATGFGATVNVAKPKKGSTVAIFGLGAVGLAAAEGARVSGASRIIGVDLNPSRFETARKFGCTEFVNPKDHNKPVQEVIADMTDGGVDRSVECTGAIQAMISAFECVHDGWGVAVLVGVPSKDDAFKTHPVNFLNERTLKGTFYGNFKPRSDIPKVVERYLNKELEVEKFITHEVTFADINKAFDLMLKGESIRCIIKMEH

SEQ ID NO: 5907 - protein, 380 aa, Fagopyrum esculentum
MSATAGQVIKCKAAVAWEAGKPLSIEEVEVAPPQKDEVRVKILFTSLCHTDVYFWEAKGQTPLFPRIFGHEGAGIVESVGEGVTEIQPGDHVLPVFTGECGDCRHCKSEESNMCDLLRINTDRVVMLSDGKSRFKYNGKPIHHFLGTSTFSEYTVVHKGCLAKINPDAPLDKTCVIRCGFATGFGATVNVAKPKKGSTVAIFGLGAVGLAAAEGARVSGASRIIGVDLNPSRFETARKFGCTEFVNPKDHKKPVQEVIADMTDGGVDRSVECTGAIQAMISAFECVHDGWGVAVLVGVPSKDDAFKTHPVNFLNERTLKGTFYGNFKPRTDIPKVVERYLNKELEVEKFITHEVTFAEINKAFDLMLKGESIRCIIKMEH

SEQ ID NO: 5908 - protein, 380 aa, Trigonella foenum-graecum
MSNTAGQVIKCRAAVAWEAGKPLVMEEVEVAPPQAGEVRLKILFTSLCHTDVYFWEAKGQTPLFPRIFGHEAGGIVESVGEGVTNLKPGDHALPVFTGECGECPHCNSEESNMCDLLRINTDRGVMISDNKSRFSIKGQPIHHFVGTSTFSEYTVVHAGCVAKINPDAPLDKVCILSCGICTGLGATVNVAKPKPGSSVAIFGLGAVGLAAAEGARMSGASRIIGVDLVSSRFELAKKFGVNEFVNPKDHKKPVQQVIAEMTNGGVDRAVECTGSIQAMISAFECVHDGWGVAVLVGVPNKDDAFETHPMNLLNERTLKGTFYGNYKPRTDLPNVVEKYMKGELELEKFITHSIPFSEINKAFDYMLKGESIRCIIRMEE

SEQ ID NO: 5909 - protein, 380 aa, Trigonella foenum-graecum
MSNTAGQVIKCRAAVAWEAGKPLVMEEVEVAPPQAGEVRLKILFTSLCHTDVYFWEAKGQTPLFPRIFGHEAGGIVESVGEGVTHLKPGDHALPVFTGECGECPHCKSEESNMCDILRINTDRGVMINDNKSRFSIKGQPIHHFVGTSTFSEYTVVHAGCVAKINPDAPLDKVCILSCGICTGLGATINVAKPKPGSSVAIFGLGAVGLAAAEGARMSGASRIIGVDLVSSRFELAKKFGVNEFVNPKDHKKPVQQVIAEMTNGGVDRAVECTGSIQAMISAFECVHDGWGVAVLVGVPNKDDAFETHPMNLLNERTLKGTFYGNYKPRTDLPNVVEKYMKGELELEKFITHSISFSEINKAFDYMLKGESIRCIIRMEE

SEQ ID NO: 5910 - protein, 380 aa, Malus domestica
MYDTAGQVIRCRAAVAWEAGKPLVVEEVEVAPPQANEVRLKILFTSLCHTDVYFWEAKGQNPLFPRIYGHEAGGIVESVGEGVTDLKAGDHVLPVFMGECKDCAHCKSEESNMCDLLRINTDRGVMLGDGKSRFSIKGKPIYHFVGTSTFSEYTVVHVGCVAKINPSAPLDKVCLLSCGISTGLGATLNVAKPKRGSTVAVFGLGAVGLAAAEGARLSGASRIIGVDLNSSKFEEAKKFGVTEFVNPKEHKKPVQEVIAELTNGGVDRSIECTGSVEAMISAFECVHDGWGVAVLVGVPHKEAVFKTHPVNFLTERTLKGTFYGNYKPRTDIPSVVEKYMNKELELEKFITHEVPFSEINKAFEYMVKGEGLRCLIHMEE

SEQ ID NO: 5911 - protein, 380 aa, Cichorium intybus
MLSLTNQVIHCKAAVAWGAGQPLVIEQVEVAPPQKMEVRIKILFTSLCHTDVYFWEAKGQNPVFPRILGHEAGAVVESVGEGVTDLQPGDHVLPIFTGECKECAHCKSEESNMCDLLRINTDRGVMIHDQKSRFSLNGKPIFHFVGTSTFSEYTVVHVGCLAKINPLAPLDKVCILSCGISTGLGATLNVAKPKKGSSVAIFGLGAVGLAAAEGARMAGASRIIGVDLNANRFELAKKFGVTEFVNPKDYKKPVQEVIAEMTNGGVDRSVECTGHIDAMISAFECVHDGWGVAVLVGVPHKDAVFKTSPLNLLNERTLKGTFFGNYKPRSDIPSVVEKYMNKELELEKFITHEVPFSEINKAFDLMLKGEGLRCIIRMDA

SEQ ID NO: 5912 - protein, 380 aa, Liriodendron tulipifera
MSSTAGLVIPCKAAVAWEAGKPLVIQQVEVAPPQAMEVRIKIKYTSLCHTDLFFWEAKGQTPLFPRIFGHEAAGIVESLGEGVTDLQVGDHVLPVFTGECKECAHCKSEESNMCDLLRINTDRGVMLNDGKSRFSINGTPINHFVGTSTFSEYTVVHVGCLAKIDPLAPLDKVCILSCGISTGLGATLNVAKPKKGSSVAIFGLGAVGLAAAEGARIAGASRIIGVDMNPNRFEEAKKFGVTEFVNPKDHNKPVQEVIAEMTNGGVDRAVECTGNVNVMISAFECVHDGWGVAVLVGVPSKDAVFMTKPINLLNERTLKGTFFGNYKPRTDLPSVVDMYMRKELEIDKFITHRIPFSEINKAFDYMVKGEGLRCIINMEE

SEQ ID NO: 5913 - protein, 380 aa, Pisum sativum
MSNTVGQIIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCDLLRINTDRGVMLNDNKSRFSIKGQPVHHFVGTSTFSEYTVVHAGCVAKINPDAPLDKVCILSCGICTGLGATINVAKPKPGSSVAIFGLGAVGLAAAEGARISGASRIIGVDLVSSRFELAKKFGVNEFVNPKEHDKPVQQVIAEMTNGGVDRAVECTGSIQAMISAFECVHDGWGVAVLVGVPSKDDAFKTHPMNFLNERTLKGTFYGNYKPRTDLPNVVEKYMKGELELEKFITHTVPFSEINKAFDYMLKGESIRCIIKMEE

SEQ ID NO: 5914 - protein, 379 aa, Vigna unguiculata
MSTAGQVIKCKAAVAWEAGKPLVMEEVEVAPPEAGEVRLKILYTSLCHTDVYFWEAKGQTPLFPRIFGHEAGGIVESVGEGVTHLKPGDHALPVFTGECGECAHCKSEESNMCDLLRINTDRGVMIHDGQTRFSIKGQPIYHFVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQQVIAEMTNGGVDRAVECTGSIQAMVSAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 5915 - protein, 383 aa, Aquilegia formosa
MASISNTTGQIIRCKAAVAWEAGKPLVIEEVEVAPPQAMEVRVKILFTSLCHTDVYFWEAKGQTPLFPRIFGHEAGGIVESVGSGVTDLKPGDHVLPMFTGECKDCAHCKSEESNMCDLLRINTDRGVMLNDGQSRFSINGKPIYHFVGTSTFSEYTVVHVGCLAKINPAAPLDKVCILSCGISTGLGAALNVAKPKQGSTVAVFGLGAVGLAACEGARIAGAKRIIGVDLNSNRFNEAKNFGVTDFVNPKDHDKPVQEVLAEMTDGGVDRSIECTGSVAAMISAFECVHDGWGVAVLVGVPNKDDAFKTHPMNLLNERTLKGTFFGNYKPRSDIPSVVEKYMNKELELEKFITHEVPFSEINKAFEYMLQGKSIRCIIRMEA

SEQ ID NO: 5916 - protein, 380 aa, Pisum sativum
MSNTVGQIIKCRAAVAWEAGKPLVIEEVEVAPPQAGEVRLKILFTSLCHTDVYFWEAKGQTPLFPRIFGHEAGGIVESVGEGVTHLKPGDHALPVFTGECGDCPHCKSEESNMCDLLRINTDRGVMLNDNKSRFSIKGQPVHHFVGTSTFSEYTVVHAGCVAKINPDAPLDKVCILSCGICTGLGATINVAKPKPGSSVAIFGLGAVGLAAAEGARISGASRIIGVDLVSSRFELAKKFGVNEFVNPKEHDKPVQQVIAEMTNGGVDRAVECTGSIQAMISAFECVHDGWGVAVLVGVPSKDDAFKTHPMNFLNERTLKGTFYGNYKPRTDLPNVVEKYMKGELELEKFITHTVPFSEINKAFDYMLKGESIRCIIKMEE

SEQ ID NO: 5917 - protein, 380 aa, Lotus japonicus
MSTTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARVSGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 5918 - protein, 380 aa, Medicago truncatula
MSNTTVQVIKCRAAVAWEAGKPLVMEEVEVAPPQAGEVRLKILFTSLCHTDVYFWEAKGQTPLFPRIFGHEAGGIVESVGEGVTHLKPGDHALPVFTGECGDCPHCKSEESNMCDLLRINTDRGVMINDNQSRFSIKGQPIHHFVGTSTFSEYTVVHAGCVAKINPDAPLDKVCILSCGICTGLGATINVAKPKPGSSVAIFGLGAVGLAAAEGARISGASRIIGVDLVSSRFELAKKFGVNEFVNPKDHDKPVQQVIAEMTNGGVDRAVECTGSIQAMISAFECVHDGWGVAVLVGVPNKDDAFKTHPMNLLNERTLKGTFYGNYKPRTDLPNVVEKYMKGELELEKFITHTIPFSEINKAFDYMLKGESIRCIIRMEE

SEQ ID NO: 5919 - protein, 380 aa, Cajanus cajan
MSNTAGQVIKCKAAVAWEAGKPLVIEEVEVAPPQAGEVRLKILYTSLCHTDVYFWEAKGQTPLFPRIFGHEAGGIVESVGEGVTHLKPGDHALPVFTGECGDCSHCKSEESNMCDLLRINTDRGVMIHDSQTRFSIKGKPIYHFVGTSTFSEYTVVHAGCVAKVNPEAPLDKICVLSCGICTGLGATVNVAKPKPGSSVAIFGLGAVGLAAAEGARISGASRIIGVDLVSSRFEEAKKFGVNEFVNPKDHDKPVQQVIAEMTNGGVDRAVECTGSIQAMISAFECVHDGWGVAVLVGVPNKDDAFKTHPMNFLNERTLKGTFYGNYKPRTDLPAVVEKYMSGELELDKFITHTVGFSEINKAFDYMLKGESIRCIIRMGE

SEQ ID NO: 5920 - protein, 380 aa, Phaseolus coccineus
MSSTAGQVIKCKAAVAWEAGKPLVMEEVEVAPPEAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHFVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPSVVEKYMNGELELDKFITHTVPFSEINKAFDYMLKGESIRCIIRMGE

SEQ ID NO: 5921 - protein, 380 aa, Prunus persica
MSSTAGLVIPCKAAVAWEAGKPLVIEKVEVAPPQAMEVRVKIMYTSLCHTDLYFWEAKGQTPLFPRIFGHEASGIIESVGEGVENLQVGDHVLPVFTGECGDCAHCKSEESNMCDLLRINTDRGVMLSDGKPRFSIKGTPINHFLGTSTFSEYTVIHSGCLAKINRLAPLDKVCILSCGISTGLGATLNVAKPKKGSSVAVFGLGAVGLAAAEGARISGASRIIGIDRNPKRFEEAKKFGVNEFVNPKDHDKPVQEVIAEMTNGGVDRSLECTGNINAMISAFECVHDGWGVAVLVGVPNKDAVFMTKPINVLNERTLKGTFFGNYKPRTHLPSVVDMYMNKELEVEKFITHRVPFSEINKAFDYMVKGEGLRCIISMEE

SEQ ID NO: 5922 - protein, 380 aa, Glycine max
MSSTAGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 5923 - protein, 381 aa, Glycine max
MSSSTVGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 5924 - protein, 381 aa, Glycine max
MSSTTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 5925 - protein, 380 aa, Glycine max
MSTTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 5926 - protein, 268 aa, Manihot esculenta
MCDLLRINTDRGHMLADGKTRFSINGKPIHHFLGTSTFSEYTVVHVGCVAKINPAAPLDKVCVLSCGISTGLGATLNVAKPKKGQSVAIFGLGAVGLAAAEGARIAGASRIIGVDLNTSRFEEAKKFGVTEFVNPKDHDKPVQQVIAEMTDGGVDRSVECTGSIQAMVSAFECVHDGWGVAVLVGVPSKDDAFKTHPVNLLNERTIKGTFFGNYKPRSDLPSVVEMYMKKELEVEKFITHHVSFSEINKAFELMLKGESLRCLINMES

SEQ ID NO: 5927 - protein, 209 aa, Quercus alba
MSSTAGQVIKCKAAVAWEAGKPLVIEEVEVAPPQANEVRMRILFTALCHTDVYFWEAKGQTPLFPRIFGHEAGGIVESVGEGVTELKPGDHVLPCFTGECGDCHHCKSEESNMCDLLRINTERGVMLNDGKTRFSKNGQPIYHFVGTSTFSEYTVVHVGCVAKINPAAPLDKVCVLSCGISTGIFECCKTQKGSICSRIWIGCCWPCCL

SEQ ID NO: 5928 - protein, 379 aa, Unknown
  Sequence found in Organisms: Brassica napus, Brassica juncea, Brassica rapa
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIYHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 5929 - protein, 379 aa, Brassica oleracea
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQEVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 5930 - protein, 379 aa, Brassica napus
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGEGIRCIITMGA

SEQ ID NO: 5931 - protein, 377 aa, Centaurea maculosa
  misc_feature (265)..(265): Xaa can be any naturally occurring amino acid
MSGKVIRCKAAVAREAGKPLVIEEVEVAPPQKMEVRLKILFTSLCHTDVYFWDAKGQNPLFPRILGHEAGGIVESVGEGVTNLKPGDKVLPIFTGECGECRHCKSEESNMCDLLRINTDRGVMINDGKTRFSKDGQPIYHFLGTSTFSEYTVVHAGCVAKINPDAPLDKVCVLSCGISTGMGATLNVAKPKKGMSVAVFGLGAVGLAAAEGARIAGASRIIGIDLNASRFNEAKKFGVTEFVNPKDHDKPIQEVIAAMTDGGVDXSVECTGNVRAMISAFECVHDGWGVAVLVGVPNKDDEFKTLPVNFLNERTLKGTFFGNYKPRTDIPGVVEKYMKKEIEVEKFITHQVGFADINKAFDYMLKGEGLRCIIRMDA

SEQ ID NO: 5932 - protein, 379 aa, Gossypium hirsutum
MSTAGQVIRCRAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGVDLNPSRFEQAKKFGVTEFVNPKDYNKPVQEVIVEMTGGGVDRSVECTGSIQAMISAFECVHDGWGVAVLVGVPNKDDEFKTHPVNLLNEKTLKGTFFGNYKPRSDIPAVVEKYMNKELELDKFITHTVPFSEINKAFELMLAGEGLRCVIRMDA

SEQ ID NO: 5933 - protein, 323 aa, Sorghum bicolor
SGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGIDLNANRFEEAKKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFTEINKAFDLMAKGEGIRCIIRMEN

SEQ ID NO: 5934 - protein, 382 aa, Vitis vinifera
MSNTAGQVIKCKAAVSWEAGKPLVIEEVELAPPQANEVRIKILFTSLCHTDVYFWEAKGQKPAFPRIFGHEAAGVVESVGEGVTDLKPGDTVLPVFTGECKECRHCKSEESNMCDLLRINTDRTVMLSDGKSRFSAKGKPIYHFLGTSTFSEYTVAHVGSVAKINPAAPLDKVCVLSCGISTGLGAAINVAKPKKGSSVAVFGLGAVGLAAAEGARISGASRIIGVDLNASRFEQAKKFGVTEFVNPKDHDKPVQEVIAEMTDGGVDRSIECTGSVAAMISAFECVHDGWGVAVLVGVPNRDDSFKTHPINLLNERTLKGTFFGNFKPRTDLPRLVEKYVNKELDLQLEKFITHEVSFSDINKAFDYMLKGEGLRCIIRMGA

SEQ ID NO: 5935 - protein, 379 aa, Gossypium hirsutum
MSTAGQVIRCRAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGVDLNPSRFEQAKKFGVTEFVNPKDYNKPVQEVIVEMTGGGVDRSVECTGSIQAMISAFECVHDGWGVAVLVGVPNKDDAFKTHPVNLLNEKTLKGTFFGNYKPRSDIPAVVEKYMNKELELDKFITHTVPFSEINKAFELMLAGEGLRCVIRMDA

SEQ ID NO: 5936 - protein, 375 aa, Coffea canephora
RPGIRCKAAVAWEAGKPLVVEEVEVAPPQRMEVRLRILVTSLCHTDVYFWEAKGQTPLFPRIFGHEAGGIVESVGEGVTDLQPGDHVLPIFTGECKDCRHCKSEESNMCDLLRINTDRGAMLHDGRTRFSKNGQPIYHFLGTSTFSEYTVVHVGSVAKINPQAPLDKVCVLSCGISTGLGATLNVAKPTKGSTVAIFGLGAVGLAAAEGARISGASRIIGVDLNANRFNDARKFGVTEFVNPKDYDKPVQQVIAEMTDGGVDRSVECTGNANAMISAFECVHDGWGVAVLVGVPNKDDAFKTHPVNLLNGRTLKGTFFGNYKPRSDIPGVVEKYMKKELELEKFITHEVPFSEINKAFDYMLRGESLRCIIRMEA

SEQ ID NO: 5937 - protein, 380 aa, Medicago truncatula
MSNTAGQIIKCRAAVAWEAGKPLVMEEVEVAPPQAGEVRLKILFTSLCHTDVYFWEAKGQTPLFPRIFGHEAGGIVESIGEGVTHLKPGDHALPVFTGECGDCPHCKSEESNMCDLLRINTDRGVMINDNQSRFSLKGQPIHHFVGTSTFSEYTVVHAGCVAKINPDAPLDKVCILSCGICTGLGATINVAKPKPGSSVAIFGLGAVGLAAAEGARISGASRIIGVDLVSSRFELAKKFGVNEFVNPKDHDKPVQQVIAEMTNGGVDRAVECTGSIQAMISAFECVHDGWGVAVLVGVPNKDDAFQTHPMNLLNERTLKGTFYGNYKPRTDLPNVVEKYMKGELELEKFITHTIPFSEINKAFDYMLKGESIRCIIRMGE

SEQ ID NO: 5938 - protein, 377 aa, Helianthus annuus
MSGEVIRCKAAVAREAGKPLVMEEVEVAPPQKMEVRLKILFTSLCHTDVYFWEAKGQNPLFPRILGHEAGGIVESVGEGVTELKPGDKVLPIFTGECGECRHCKSEDSNMCDLLRINTDRGVMINDGKSRFSKDGQPIYHFLGTSTFSEYTVVHSGCVAKINPDAPLDKVCVLSCGISTGMGATLNVAKPKKGMSVAIFGLGAVGLAAAEGARIAGASRIIGIDLNPSRANEAKKFGVTEFVNPKDHDKPIHEVIAEMTDGGVDRSVECTGNVKAMISAFECVHDGWGVAVLVGVPNKDDEFKTLPINFLNERTLKGTFFGNYKPRTDIPGVVEKYMNKELEVEKFITHSVGFSEINKAFDYMLKGESLRCIIRMDA

SEQ ID NO: 5939 - protein, 379 aa, Thellungiella halophila
MSTTGQIIRCKAAVAWEAGKPLVMEEVEVAPPQKHEVRIKILFTSLCHTDVYFWEAKGQTPLFPRIFGHEAGGIVESVGEGVTDLSPGDHVLPIFTGECGDCRHCHSEESNMCDLLRINTERGAMIHDGESRFSIKGKPIHHFLGTSTFSEYTVVHSGQVAKINPAAPLDKVCIVSCGVSTGLGATLNVAKPKKGQSVAIFGLGAVGLAAAEGARIAGAARIIGVDLNPNRFEEAKKFGVTEFVNPREHDKPVQQVIAEMTDGGVDRSVECTGSIQAMIQAFECVHDGWGVAVLVGVPSKDDAFKTHPMNLLNERTLKGTFFGNYKPKTDIPGVVEQYMNKELELEKFITHSVPFSEINKAFDYMARGEGIRCIITMGA

SEQ ID NO: 5940 - protein, 376 aa, Solanum lycopersicum
WSCDCFCVAAVAWEAGKPLVIEEVDVAPPQKHEVRLKILFTSLCHTDVYFWEAKGQTPLFPRIFGHEAGGIVESVGEGVTDLQPGDHVLPVFTGECQQCRHCKSSESNMCELLRINTDRGVMISDGQTRFSKDGKPIYHFVGTSTFSEYTVAHSGCVTKIDPQAPLDKVCVLSCGISTGLGATLNVAKPTRGSYVAIFGLGAVGLAAAEGARLAGASRIIGIDLNPSRFNDAKKFGVTEFVNPKDHDKPVQEVIAEMTNGGVDRSVECTGNVNAMISAFECVHDGWGVAVLVGVPNKDDAFKTHPMNLLNERTLKGTFFGNYKPKTDLPSVVAKYMNKELELEKFITHQVPFSEINKAFDIMLKGEGLRCMITMGR

SEQ ID NO: 5941 - protein, 362 aa, Trigonella foenum-graecum
MSNTANKVIKCRAAVAWEAGKPLVMEEVEVAPPQAGEVRLKILFTSLCHTDVYFWEAKGQTPLFPRIYGHEAGGIVESIGEGVTNLKPGDHALPVFTGECGECPHCKSEESNMCNLLRINTDRGVMISDNKSRFSIKGQPIHHFVGTSTFSEYTVVHAGCVAKINPDAPLDKVCILSCGICTGLGATINVAKPKPGSSVAIFGLGAVGLAAAEGARMSGASRIIGVDLVSSRFELAKKFGVNEFVNPKDHDKPVQQVIAEMTNGGVDRAVECTGSVQAMISAFECVHDGWGVAVLVGVPNKDDAFKTHPMNLLNERTLKGTFYGNYKPRTDLPNVVEKYMKGELELEKFITHSIPFSEITSF

SEQ ID NO: 5942 - protein, 380 aa, Amsonia hubrichtii
MSSTAGLVIPCKAAVSWEAGKPLVIEQVEVAPPQALEVRVKIKYTSLCHTDLYFWEAKGQTPVFPRIFGHEAAGIVESVGEGVSDLQVGDHVLPVFTGECGQCAHCMSEESNMCNLLRINTDRGVMLSDGKSRFSIDGNPINHFLGTSTFSEYTVVHSGCLAKLNPLAPLDKVCILSCGISTGLGATLNVAKPKKGSSVAIFGLGAVGLAAAEGARIAGASRIIGVDLNPNRFEGAKKFGVTDFVNPKDHERPVQEVIAEMTNGGVDRSVECTGNINAMISAFECVHDGWGVAVLVGVPNKDAVFMTKPINLLNERTLKGTFFGNYKPRTDLPSVVDMYMNKKLELEKFITHHVPFSEINKAFDYMLRGEGLRCIINMEE

SEQ ID NO: 5943 - protein, 379 aa, Gossypium hirsutum
MSTAGQVIRCRAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFSINGKPIYHFLGTSTFSEYTVVHVGQVAKINPEAPLDKVCVLSCGMSTGFGATVNVAKPKKGQSVAIFGLGAVGLAAAEGARVSGASRIIGVDLNPSRFEQAKKFGVTEFVNPKDYNKPVQEAIVEMTGGGVDRSVECTGSIQAMISAFECVHDGWGVAVLVGVPNKDDAFKTHPVNLLNEKTVKGTFFGNYKPRSDIPAVVEKYMNKELELDKFITHTVPFSEINKAFELMLAGEGLRCVIRMDE

SEQ ID NO: 5944 - protein, 380 aa, Arachis hypogaea
MSTTSGLVIPCKAAVAWEAGKPLVIEKVEVAPPQAMEVRIKVKYTSLCHTDLYFWEAKGQTPLFPRIFGHEAAGIVESVGEGVTDLQVGDHVLPVFTGECGECAHCKSEESNMCDLLRIDTERGVMHSDGKSRFSINGTPINHFVGTSTFSEYTVIHSGCLAKLNPLAPMDKVCVLSCGISTGLGATLNVAKPKKGSTVAVFGLGAVGLAAAEGARIAGASRIIGIDLNPNRFEEAKKFGITDFVNPQDYDRPVQQVIAEMTNGGVDRSIECTGNINAMISAFECVHDGWGVAVLVGVPTKDAVFMTKPINLLNERTLKGTFFGNYKPRTDLPSVVDMYMNKKLELDKFITHRVPFSEINKAFDLMLRGEGLRCIISMED

SEQ ID NO: 5945 - protein, 380 aa, Castanea mollissima
MSSTTGQVIKCKAAVAWEAGKPLVIEEVEVAPPQANEVRIKILFTSLCHTDVYFWEAKGQTPLFPRIFGHEAGGIVESVGEGVTELKPGDHVLPCFTGECGDCHHCKSEESNMCDLLRINTERGVMLNDGKTRFSKNGQPIFHFVGTSTFSEYTVVHIGCVAKINPAAPLDKVCVLSCGISTGMGATLNVAKPKKGQSVAVFGLGAVGLAACEGARMAGASRIIGIDLHSGRFEEAKKFGVTECVNPKDHDKPIQEVIAEMTDGGVDRAVECTGSIQAMISAFECVHDGWGVAVLVGVPSKDDSFKTHPMNFLNERTLKGTFFGNYKPRTDIPSVVEKFMNKELELDKFITHSVPFSEINKAFDYMRDGHSIRCIICMDA

SEQ ID NO: 5946 - protein, 357 aa, Mimulus guttatus
MSSTEGQVIRCKAAVSWEAGKPLVIEEVEVAPPQKMEVRVKILFTSLCHTDVYFWEAKGQTPLFPRIFGHEAGGIVESVGEGVTDLKPGDHVLPVFTGECKECRHCKSSESNMCDLLRINTERGAMIEDGKTRFSKDGKPIHHFLGTSTFSEYTVVHVGCLAKINPSAPLDIVCVLSCGISTGLGATLNVAKPTKGSTVAIFGLGAVGLAAAEGARISGATRIIGVDLNPSRFNEAKKFGVTEFVNPKNYDKPVQEVIAEMTDGGVDRSIECTGNVNAMISAFECVHDGWGVAVLVGVPNKDDAFKTHPVNLLNERTLKGTFFGNYKPRSDIPNVVEKYMNKILGMAGAGAGSHSRR

SEQ ID NO: 5947 - protein, 374 aa, Arnica chamissonis
NVIRCKAAVAREAGKPLVIEEVEVAPPQKMEVRLKILFTSLCHTDVYFWEAKGQNPLFPRILGHEAGGIVESVGEGVTELKPGDKVLPVFTGECGECRHCKSEESNMCDLLRINTDRGTMINDGKTRFSKDGQPIYHFLGTSTFSEYTVVHSGCVAKINPDAPLDKVCVLSCGISTGMGATLNVAKPRKGMSVAIFGLGAVGLAAAEGARIAGASRIIGIDLNASRANEAKKFGVTEFVNPKDHDKPIHEVIAAMTDGGVDRSVECTGNVKAMISAFECVHDGWGVAVLVGVPNKDDEFKTLPINFLNERTLKGTFFGNYKPRTDIPGVVEKYMKKELEVEKFITHHVGFSEINKAFDYMLKGESLRCIIQMDA

SEQ ID NO: 5948 - protein, 380 aa, Malus domestica
MSSTAGLVIPCTAAVAWEAGKPLVMERVEVAPPQAMEVRVKIKYTSLCHTDLYFWEAKGQTPLFPRIFGHEASGIVESVGEGVEGLEVGDHVLPVFTGECGDCAHCKSEESNMCDLLRINTDRGVMLSDEKPRFSINGTPINHFVGTSTFSEYTVIHSGCLAKINPLAPLDIVCILSCGITTGLGATLNVAKPKKGSSVAIFGLGAVGLAAAEGARISGASRIIGVDRNPKRFEEAKKFGVNEFVNPKDHDKPVQEVIAEMTNGGADRSIECTGNINAMISAFECVHDGWGVAVLVGVPNKDAVFMTKPINLLNERTLKGTFFGNYKPRTDLPSVVEMYMNKKLEVEKFITHRVPFSEINKAFDYMIRGEGLRCIVSMEE

SEQ ID NO: 5949 - protein, 380 aa, Malus domestica
MSSTAGLVIPCTAAVAWEAGKPLVMERVEVAPPQAMEVRVKIKYTSLCHTDLYFWEAKGQTPLFPRIFGHEASGIVESVGEGVEGLEVGDHVLPVFTGECGDCAHCKSEESNMCDLLRINTDRGVMLSDEKPRFSINGTPINHFVGTSTFSEYTVIHSGCLAKINPLAPLDIVCILSCGITTGLGATLNVAKPKKGSSVAIFGLGAVGLAAAEGARISGASRIIGVDRNPKRFEEAKKFGVNEFVNPKDHDKPVQEVIAEMTNGGADRSIECTGNINAMISAFECVHDGWGVAVLVGVPNKDAVFMTKPINLLNERTLKGTFFGNYKPRTDLPSVVEMYMSKKLEVEKFITHRVPFSEINKAFDYMIRGEGLRCIVSMEE

SEQ ID NO: 5950 - protein, 379 aa, Arabidopsis lyrata
MPTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCIITMGA

SEQ ID NO: 5951 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 5952 - protein, 380 aa, Castanea mollissima
MSTTSGLVIPCKAAIAWEAGKPLVIEQVEVAPPQAMEVRIKIKYTSLCHTDLYFWEAKGQNPLFPRIFGHEAAGVVESVGEGVSDLQVGDHVLPVFTGECGDCRHCKSEESNMCDLLRINTDRGVMLNDGKSRFSISGTPINHFLGTSTFSEYTVIHSGCLAKISPLAPLDKVCILSCGISTGLGATLNVAKPKKGSTVAVFGLGAVGLAAAEGARIAGASRIIGIDLNPKRYEEAKKFGVTEFVNPKDHDRPVQEVIAEMTNGGVDRSIECTGNINAMISAFECVHDGWGVAVLVGVPNKDAVFMTKPINVLNERTLKGTFFGNYKPRTDLPSVVDMYMNKKLEVEKFITHRVPFSDINKAFEYMLKGEGLRCIISMEE

SEQ ID NO: 5953 - protein, 380 aa, Zingiber officinale
MSSTAGQVIKCRAAVSWEAGKPLTIEEVEVAPPQAMEVRIKVLFTSLCHTDVYFWEAKGQKPMFPRIFGHEAAGIVESVGEGVTDLVPGDHVLPVFTGECKECAHCLSSDSNMCSLLRINTDRGVMLADGQSRFSINGQPIYHFLGTSTFSEYTVVHSGCVAKINPLAPLDKVCILSCGFCTGFGATVNVAKPPKGSAVAIFGLGAVGLSAAEGARVSGASRIIGVDINPNRFEEAKNFGVNEFVNPKDYDRPVQEVIAEMTNGGVDRSVECTGNIDAMISAFECVHDGWGVAVLVGVPHKDAVFKTHPVNFLNERTLKGTFYGHYKPRTDLPGVVEKYLNKEIELEKFITHEVSFSDINKAFDYMLQGASLRCIIRMVD

SEQ ID NO: 5954 - protein, 379 aa, Tropaeolum majus
MSTAGQVIRCKAAVAWEAGKPLVIEEVEVSPPQANEVRVKILYTSLCHTDVYFWEAKGQTPRFPRIFGHEAGGIVESVGEGVTTLQPGDHVLPIFTGECGDCRHCHHEESNMCELLRINTERTEMLTDGTSRFSIKGQPINHFVGTSTFSEYTVIHYGCLAKINPAAPLDKVCVLSCGLSTGFGAAVNVAKTKKGETVVVFGLGAVGLAAAEGARVSGASRIIGVDLNPARFEGAKKFGVTEFVNPKDHNKPVQEVIADMTNGGADKSIECTGAVQAMISAFECVHDGWGVAVLVGVPNRDDAFKTHPMNLLNERTLKGTFFGNFKPRTDIPKVVERYMSKELEVEKFITHTVPFSEINKAFELMARGEGIRCIIRMEE

SEQ ID NO: 5955 - protein, 380 aa, Quercus alba
MSATSGLVIPCKAAIAWEAGKPLVIEQVEVAPPQTMEVRIKIKYTSLCHTDLYFWEAKGQNPLFPRIFGHEAAGVVESVGEGVSDLQVGDHVLPVFTGECGDCRHCKSEESNMCDLLRINTDRGVMLNDGKSRFSINGTPINHFLGTSTFSEYTVVHSGCLTKISPLAPLDKVCILSCGISTGLGATLNVAKPKKGSTVAVFGLGAVGLAAAEGARIAGASRIIGIDFNPKRFEEAKKFGVTEFVNPKDHDRPVQEVIAEMTNGGVDRSLECTGNINAMISAFECVHDGWGVAVLVGVPNKDAVFMTKPINVLNERTLKGTFFGNYKPRTDLPSVVDMYMNKKLEVEKFITHRVPFSDINKAFEYMLKGEGLRCIISMEE

SEQ ID NO: 5956 - protein, 192 aa, Cucurbita pepo
MSSTAGQVIKCKAAVAWEAGKPLVIEEVEVAPPQANEVRVKILFTALCHTDVYFWEAKGQTPLFPRIFGHEAGGVVESVGEGVKDLQPGDHVLPVFTGECGDCRHCKSEESNMCDLLRINTDRGVMISDGKTRFSKNGQPIHHFVGTSTFSEYTVIHFGCLAKINPAAPLDKVCVLAAEFHRLWCHCECCKA

SEQ ID NO: 5957 - protein, 378 aa, Petunia hybrida
MSSNTAGQVIRCKAAVAWEAGKPLVIEEVEVAPPQKMEVRLKILFTSLCHTDVYFWEAKGQTPLFPRIFGHEAGGIVESVGEGVTDLKPGDHVLPVFTGECQQCRHCKSEESNMCDLLRINTDRGVMIHDGQTRFSKMGSRYTLSWNSPLVIPVASERPKIDPQAPLDKVCVLSCGISTGLGATLNVAKPTKGSTVAIFGLGAVGLAAAEGARIAGASRIIGVDLNPSRFNDAKKFGVTEFVNPKDHGDKPVQQVIAEMTDGGVDRSVECTGNVNAMISAFECVHDGWGVAVLVGVPNKDDAFKTHPMNLLNERTLKGTFFGNYKPKSDIPSVVDKYMKKELELEKFITHQVPFSEINKAFDYMLKGESIRCMITMEH

SEQ ID NO: 5958 - protein, 380 aa, Quercus alba
MSATSGLVIPCKAAIAWEAGKPLVIEQVEVAPPQTMEVRIKIKYTSLCHTDLYFWEAKGQTPLFPRIFGHEAAGVVESVGEGVSDLQVGDHVLPVFTGECGDCRHCKSEESNMCDLLRINTDRGVMLNDGKSRFSINGTPINHFLGTSTFSEYTVVHSGCLTKISPLAPLDKVCILSCGISTGLGATLNVAKPKKGSTVAVFGLGAVGLAAAEGARIAGASRIIGIDLSPKRYEEAKKFGVTEFVNPKDHDRPVQEVIAEMTNGGVDRSIECTGNINCMISAFECVHDGWGVAVLVGVPNKDAVFMTKPINVLNERTLKGTFFGNYKPRTDLPSVVDMYMNKKLEVEKFITHRVPFSDINKAFEYMLKGEGLRCIISMEE

SEQ ID NO: 5959 - protein, 379 aa, Tropaeolum majus
MSTAGQVIRCKAAVAWEAGKPLVIEEVEVAPPQANEVRVKILYTSLCHTDVYFWEAKGQTPRFPRIFGHEAGGIVESVGEGVTTLQPGDHVLPIFTGECGDCRQCHHEESNMCELLRINTERTEMLSDGKSRFSIKGQPINHFVGTSTFSEYTVVHYGCLAKINPAAPLDKVCVLSCGLSTGYGAAVNVAKTSKGETVVVFGLGAVGLAAAEGARVSGASRIIGVDLNPDRFEPAKKFGVTEFLNPRDHNKPVQEVIADMTNGGADKSIECTGSVQAMISAFECVHDGWGVAVLVGVPNKDDAFKTHPMNFLNERTLKGTFFGNFKPRTDIPKVVEKYMNKELEVEKFITHTIPFSEINTAFELMARGEGIRCIIRMEE

SEQ ID NO: 5960 - protein, 379 aa, Tropaeolum majus
MSTAGQVIRCKAAVAWEAGKPLVIEEVEVAPPQANEVRVKILYTSLCHTDVYFWEAKGQTPRFPRIFGHEAGGIVESVGEGVTTLQPGDHVLPIFTGECGDCRQCHHEESNMCELLRINTERTEMITDGTSRFSIKGQPINHFVGTSTFSEYTVIHYGCLAKINPAAPLDKVCVLSCGLSTGFGAAVNVAKTKEGETVVVFGLGAVGLAAAEGARVSGASRIIGVDLNPARFEGAKKFGVTEFVNPKDHNKPVQEVIADMTNGGADKSIECTGAVQAMISAFECVHDGWGVCVLVGVPNRDDSFKTHPMNLLNERTLKGTFFGNFKPRTDIPKVVERYMNKELEVEKFITHTVPFSEINKAFELMARGEGIRCIIRMEE

SEQ ID NO: 5961 - protein, 379 aa, Raphanus sativus
MSTIGQIIRCKAAVAWEAGKPLVMEEIEVAPPQKHEVRIKILFTSLCHTDVYFWEAKGQTPLFPRIFGHEAGGVVESVGEGVTDLQPGDHVLPIFTGECGDCPHCHSEESNMCDLLRINTERGGMIHDGQSRFSINGKPIYHFLGTSTFSEYTVVHSGQVAKINPDAPLDKVCIVSCGLSTGMGATLNVAKPKKGQSVAVFGLGAVGLAAAEGARMAGAGRIIGVDLNPKRFEEAKKFGVTEFVNPREHDKPVQQVIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 5962 - protein, 379 aa, Raphanus sativus
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSINGKPVHHFLGTSTFSEYTVVHSGQVAKINPEAPLDKVCIVSCGLSTGMGATLNVAKPKKGQSVAVFGLGAVGLAAAEGARMAGAGRIIGVDLNPKRFEEAKKFGVTEFVNPREHDKPVQQVIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 5963 - protein, 373 aa, Hordeum vulgare
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVAKPKKGMTVAIFGLGAVGLAAMEGARMSGASRIIGVDLNPAKHEQAKKFGCTDFVNPKDHTKPVQEVIVEMTDGGVDRAVECTGNADAMISAFECVHDGWGVAHKEAVFKTHPMNFLKERTLRGTFFGNYKPRTGLPGVVDMYVRKELELDKFITHSVPFSQINTAFDLMLRGEGLRCVIRMEE

SEQ ID NO: 5964 - protein, 78 aa, Cucumis sativus
MSSTKGQVIKCKAAVAWEAGKPLVIESISSDQHIDFVEVLRSFSLLFATLMFTSGRPRAKHLCSLEYLDMKLEELWRA

SEQ ID NO: 5965 - protein, 373 aa, Hordeum vulgare
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFLNERTLRGTFFGNYKPRTGLPGVVDMYMRKELELDKFITHSLPFSQINTAFDLMLRGEGLRCVIRMEE

SEQ ID NO: 5966 - protein, 377 aa, Lactuca sativa
MSGEVIRCKAAVAWEAGKPLVIEEVEVAPPQKMEVRLKILFTSLSHTDVYFWEAKGQNPLFPRILGHEAGGIVESVGEGVTELQPGDKVLPVFTGECGECRHCKSEESNMCDLLRINTDRGTMINDGKTRFSKDGNPIYHFLGTSTFSEYTVVHSGCVAKINPDAPLDKVCVLSCGISTGMGATLNVAKPKKGMTVAVFGLGAVGLAAAEGARIAGASRIIGIDLNESRADEAKKFGVTEFVNPKDHDKPIQEVIVAMTDGGVDRSVECTGNVRAMISAFECVHDGWGVAVLVGVPSKDDEFKTLPINFLNERALKGTFFWHYKPRTDIPGVVEKYMNKEIEVEKFITHQVGFSDINKAFDLMLKGESLRCIIQMDA

SEQ ID NO: 5967 - protein, 379 aa, Carica papaya
MSAAGQVICCRAAVAWEAGKPLVMEEVEVAPPQQNEVRLKILFTSLCHTDVYFWEAKGQAPLFPRIFGHEAAGIVESIGEGVTHLQPGDHVLPIFTGECGEGRHCHSEESNMCDLLRINTERGVMISDGKSRFSIDGKPIHHFLGTSTFSEYTVVHAGCVAKINPAAPLDKVCIVSCGLSTGFGATVNVAKPKKGDTVAIFGLGAVGLAAAEGARVSGASRIIGVDLNPNRFEEAKKFGVTEFVNPKDYNKPVQEVIAEMTDGGVDRSIECTGSIQAMISAFECVHDGWGVAVLVGVPNRDDAFKTHPVNFLNERTLKGTFFGNYKPRTDIPGVVEKYMNKELELEKFITHNIAFSEINKAFDYMLKGESLRCIIHMEE

SEQ ID NO: 5968 - protein, 140 aa, Gossypium hirsutum
MSTAGQVIRCKAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFPINGKPI

SEQ ID NO: 5969 - protein, 343 aa, Cajanus cajan
MSSTAGQTIKCKAAVSWEAGKPLVIDEVEVAPPQAGEVRLKILYTSLCHTDVYFWEAKGQTPLFPRIFGHEASGIVESVGEGVTHLEPGDHALPVFTGECGECVHCKSEESNMCELLRINTDRGVMINDGKSRFSKDGQPIHHFLGTSTFSEYTVIHAGCVAKINPDAPLDKVCVLSCGICTGLGATVNVAKPKPGSSVAIFGLGAVGLAAAEGARISGASRIIGIDLVSARFEQAKKFGVNEFVNPKEHDKPVQQVIAEMTNGGVDRAVECTGSIQAMISAFECVHDGWGLAVLVGVPSKDDAFKTAPINFLNERTLKGTFYGNYKPRTDLPSVVEQYMRGS

SEQ ID NO: 5970 - protein, 380 aa, Manihot esculenta
MSSTTGLVIPCKAAVAWEAGKPLVIEQVEVAPPQALEVRIKIKYTSLCHTDLYFWEAKGQTPLFPRIFGHEAAGVVESVGEGISDLKVGDHVLPVFTGECGECKHCESEESNMCDLLRINTDRGVMLSDGKSRFSIDGVPINHFLGTSTFSEYTVVHRGCLAKINPLAPLDKVCILSCGISTGLGATLNVAKPKKGSSVAVFGLGAVGLAAAEGARIAGASRIIGVDLNPSRFEEAKKFGVTDFVNPKEHDRPVQEVIAEMTNGGVDRSVECTGHIDAMISAFECVHDGWGVAVLVGVPNKEAVFMTKPINVLNERTLKGTFFGNYKPRTDLPSVVDMYMKKKLELDKFITHRLSFSDINKAFELMVKGQGLRCIINMEE

SEQ ID NO: 5971 - protein, 380 aa, Glycine max
MSSTVGQTIKCKAAIAWEAGKPLVIEEVEVAPPQAGEVRLKILYTSLCHTDVYFWDAKGQTPLFPRIFGHEASGIVESVGEGVTHLKPGDHALPVFTGECGDCAHCKSEESNMCELLRINTDRGVMIHDGQSRFSKNGQPIHHFLGTSTFSEYTVVHAGCVAKINPAAPLDKVCVLSCGICTGFGATVNVAKPKPGSSVAIFGLGAVGLAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEINKAFDLMLKGQSIRCIIRMQE

SEQ ID NO: 5972 - protein, 275 aa, Nicotiana benthamiana
MFSHESLNTTAIAWEAGKPLVIEEVEVAPPQKSEVRLKILFTSLCHTDVYFWEAKGQTPLFPRIFGHEAGGIVESVGEGVTDLQPGDHVLPVFTGECQQCRHCKSEESNMCDLLRINTDRGVMIHDGQTRFSKDGKPIYHFVGTSTFSEYTVVHSGCVAKIDPQAPLDKVCVLSCGISTGLGATLNVAKPTKGSTVAIFGLGAVGLAAAEGARIAGASRIIGIDLNPSRFNDSKKFGVTEFVNPKDYDKPVQQVIAEMTDGGVDRSVECTGKSTP

SEQ ID NO: 5973 - protein, 379 aa, Vigna unguiculata
MSTVGQTIKCKAAIAWEAGKPLVIEEVEVAPPQTGEVRLKIHYTSLCHTDVYFWEAKGQTPLFPRIFGHEASGIVESVGEGVTHLQPGDHALPVFTGECGDCVHCKSEESNMCELLRINTDRGVMISDGKSRFSKDGKPIHHFLGTSTFSEYTVLHAGCVAKINPAAPLDKVTVLSCGICTGLGATVNVAKPKPGSSVAIFGLGAVGLAAAEGARICGAKRIIGIDLVPERFEQAKKFGCNEFVNPKDHDKPIQQVIAEMTNGGVDRAVECTGSIQAMVSAFECVHDGWGVAVLVGVPSKDDAFKTAPINFLNERTLKGTFYGNYKPRTDLPGVVEKYLSGELEVDKFITHSVPFTEINKAFDYMLKGESIRCLIRMQD

SEQ ID NO: 5974 - protein, 275 aa, Manihot esculenta
MCELLRINTERGVMIEDGKSRFSIKGKPIYHFLGTSTFSEYTVVHSGCVAKINPSAPLDTVFVLSCGFCTGFGATVNVAKPPKGSTVAVFGLGAVGLAAAEGARFSGASRIIGVDVNPNKFEQAKKFGVTEFVNPKDYDKPVQEVLVEMTNGGVDRSIECTGNVQAMISAFESVHDVCILFFLGWGVAVLVGVPSKDDVFKTHPLNFLTERTLKGTFYGNFKPRTDIPLVVEKYMNKEIELEKFITHSVPFSDINTAFDLMLKGEGIRCLIRMEE

SEQ ID NO: 5975 - protein, 380 aa, Eucalyptus grandis
MSSTAGFMIPCKAAVAWEAGKPLVIQQVEVAPPQAMEVRMKVKYTSLCHTDLYFWEAKGQTPLFPRIFGHEAAGVVESVGEGVSDVAVGDHVLPVFTGECGECRHCQSEESNMCDLLRINTERGVMLSDGKSRFSINGTPINHFLGTSTFSEYTVVHAGCLAKINPLAPLDKVCIVSCGVSTGLGATLNVAKPKQGSSVAIFGLGAVGLAAAEGARIAGASRIIGVDLNPNRFEEAKKFGVTEFVNPKDYDRPVQQVIAEMTDGGVDRSVECTGNINAMVSAFECVHDGWGVAVLVGVPNKDAVFMTKPINILNERTLKGTFFGNYKPRSDIPSVVDMYLNKKLELDKFITHRVPFSEINKAFDLMVKGEGLRCIINMED

SEQ ID NO: 5976 - protein, 511 aa, Zea mays
MAAAAAAAVAHLSIHGRLRRSPEHRPSITTTTTSSSSSSAHRPSLLRCRAFKQEAGDGDPAEADARKRRKGPLYKLKAAIQGLAGSRSAAAEVYGGEYQYQRAVEKAEEIFFSVATQLGRYVITMMSSGVVLGVGFQLSGGDSQMNELIWYSWLGGVIIGTMIGANSVLEEHCKAGPRNVVITGSTRGLGKALAREFLLSGDRVVITSRSPESVLQTIKELEENIQEGLSVAKKKQRNILSHAKVVGTDCDVCKPEDVKELVNFAINELGSVDIWINNAGTNKGFRPLVTFSDDDITQIVSTNLVGSLLCTREAMNVMQYQEKGGHIFNMDGAGSGGSSTPLTAVYGSTKCGLKQFQGSLLNESRRSKVGVHTASPGMVLTDLLLSGSSLRNKQMFNLICELPETVARTLVPRMRVVKGSGKAINYLTPPRILLALVTAWVRRGRWFDDEGRAVYAAEADRIRNWAESRARFSFTDAMEMYTENTWVSVFSLSVVCAFIILSSSGGPLPGT

SEQ ID NO: 5977 - protein, 504 aa, Setaria italica
MAAAAHLSVHGSLRRSAAELPSTSSHRPSLLRCRAFKQEADGGDRDDPSASSSSPPNEARKRRKKGPLYKLKAAIQGLAGSRSAAAEVYGGEYQRAVEKAEEIFFSVATHLGKYVITMMSSGVVLGVGFQLSGGDSQMNELIWYSWLGGVIIGTMIGANSVLEEHCKAGPRNVVITGSTRGLGKAIAREFLLSGDHVVITSRSPESVLQTIKELEENIQEGLSVAKKKERKILSNAKVVGTACDVCKPEDVKKLVNFAINELGSVDIWINNAGTNKGFRPLVTFSDDDITQIVSTNLVGSLLCTREAMNVMQYQEKGGHIFNMDGAGSGGSSTPLTAVYGSTKCGLRQFQASLLKESRRSKVGVHTASPGMVLTDLLLSGSSLRNKQMFNLICELPETVARTLVPRMRVVKGSGKAINYLTPPRILLALVTAWVRRGRWFDDEGRAVYAAEADRIRNWAESRARFSFTDAMEMYTENTWVSVFSLSVVCAFIILSSSGGPLPGT

SEQ ID NO: 5978 - protein, 504 aa, Oryza sativa
MAAAAVVHLSVHGRLRRSPELHARPYHRPSLLRCRAFKQEADNGGEEASSSPPPPTTAEARRRRKGPLYKLKAAIQGLAGSRSAAAEAYGGEYQRAVEKAEEIFFSVATQVGRYVITMMSSGVVLGVGFQLSGGDSQMNTLIWYSWLGGVIIGTMIGANSVLEEHCKAGPRNVVITGSTRGLGKALAREFLLSGDRVVIASRSPESVLQTINELEENIQEGLSVAKKKQREILLHAKVVGTSCDVCKPEDVKKLVNFAKDELGSIDIWINNAGTNKGFRPLVNFSDEDISQIVSTNLVGSLLCTREAMNVMQHQQKGGHVFNMDGAGSGGSSTPLTAVYGSTKCGLRQFQASLLKESRRSKVGVHTASPGMVLTDLLLSGSSLRNKQMFNLICELPETVARTLVPRMRVVKGSGKAINYLTPPRILLALVTAWVRRGRWFDEEGRAVYAAEADRIRNWAESRARFSFTDAMEMYTENTWVSVFSLSVVCAFIILSSSGGPLPGT

SEQ ID NO: 5979 - protein, 496 aa, Brachypodium distachyon
MAAAVVHLSVHGRLRRSPDILSQTCYRPSLLRCRAFKQETGGDDEKPSPTEARKRKKGPLYKLKAAIQGLAGSRSAAAEVYGGQYELAVEKAEEIFFSVATQLGRYVITMMSSGVVLGVGFQLSGGDSQMNTLIWYSWLGGVIIGTMIGANSVLEEHCKAGPRNVVITGSTRGLGKALAREFLLSGDRVVVASRSPQSVLQTISELEENIQEGLSVAKKKQREALLQAKVVGTSCDVCKPEDVKKLVNFAVDELGSIDIWINNAGTNKGFRPLVNFSDEDISQIVSTNLVGSLLCTREAMDVMQNQEKGGHVFNMDGAGSGGSSTPLTAVYGSTKCGLRQFQASLMTESKRSKVGVHTASPGMVLTDLLLSGSSLQNKQMFNIICELPETVARTLVPRMRVVKGSGKAINYLTPPRILLALVTAWVRRGRWFDEEGRAVYAAEADRIRNWAESRTRFSFTDAMEMYTENTWVSVFSLSVVCAFIILSSSGGPFPGT

SEQ ID NO: 5980 - protein, 495 aa, Triticum aestivum
MAAAVVHLSVHGRLRRSPEAVVSQACHRPSLLRCRAFKQEAGGDDEKPNEPRKRRKGPLYTLKAAMQGLAGSRSAAAEVYGGQYELAVEKAEEIFFSVATQVGRYVITMMSSGVVLAVGFQLSGGDSQTDALIWYSWLGGVIIGTMLGANSVLEEHCKAGPRNVVITGSTRGLGKALAREFLLSGDHVVIASRSPESVLQTINELEENIQEGLSVAKKKQRETLLQAKVVGTSCDVCKPEDVKKLVNFAVGELGSIDIWINNAGTNKGFRPLVNFSDEDITQIVSTNLVGSLLCTREAMDVMQYQEKGGHVFNMDGAGSGGSSTPLTAVYGSTKCGLRQFQASLMKESRRSKVGVHTASPGMVLTDLLLSGSSLQNKQMFNIICELPETVARTLVPRMRVVKGSGKAVNYLTPPRILLALVTAWVRRGRWFDEEGRAVYAAEADRIRNWAESRTRFSFTDAMEMYTENTWVSVFSLSVVCAFIMLSSSGGPFPGT

SEQ ID NO: 5981 - protein, 497 aa, Avena sativa
MAAAVVHLSVHGRLRRSPETVPQTCYRPSLLRCRAFKQEAGGDDENKPSSPPPKRRKGPLYKLKAAMQGLAGSRSAAAEVYGGQHEYERAVEKAEEIFFSVATQVGRYVITMISSGVVLAVGFQLSGGDSQTDALIWYSWLGGVIIGTMIGANSVLEEHCKAGPRNVVITGSTRGLGKALAREFLLSGDRVVVASRSPDSVLQTIDELEANIQEGLSVAKKKQRETLLQAKVVGTSCDVCKPEDVKKLVNFAVEELGSIDIWINNAGTNKGFRPLVNFSDEDITQIVSTNLVGSLLCTREAMDVMQYQEKGGHVFNMDGAGSGGSSTPLTAVYGSTKCGLRQFQASLMKESRRSKVGVHTASPGMVLTDLLLSGSSLQNKQMFNIICELPETVARTLVPRMRVVKGSGKAVNYLTPPRILLALVTAWVRRGRWFDEEGRAVYAAEADRIRNWAESRARFSFTDAMEMYTENTWVSVFSLSVVCAFIMLSSSGGPFPG

SEQ ID NO: 5982 - protein, 499 aa, Triticum aestivum
MAAAVVHLSVHGRLRRSPEAVVSQACHRPSLLRCRAFKQEAGGDHHKPSSPPNEPRKRRKGPLYTLKAAMQGLAGSRSAAAEVYGGQYELAAEKAEEIFFSVATQVGRYVITMMSSGVVLAVGFQLSGGDSQTDALIWYSWLGGVIIGTMLGANSVLEEHCKAGPRNVVITGSTRGLGKALAREFLLSGDHVVIASRSPDSVLQTINELEENIQEGLSVAKKKQRETLLQAKVVGTSCDVCKPEDVKKLVNFAVGELGSIDIWINNAGTNKGFRPLVNFSDEDITQIVSTNLVGSLLCTREAMDVMQYQEKGGHVFNMDGAGSGGSSTPLTAVYGSTKCGLRQFQASLMKESRRSKVGVHTASPGMVLTDLLLSGSSLQNKQMFNIICELPETVARTLVPRMRVVKGSGKAVNYLTPPRILLALVTAWVRRGRWFDEEGRAVYAAEADRIRNWAESRTRISFTDAMEMYTENTWVSVFSLSVVCAFIMLSSSGGPFPGT

SEQ ID NO: 5983 - protein, 454 aa, Pennisetum glaucum
DGDGPSSTKRRKKGPLYKLKAAIQGLAGSRSAAAEVYGGEHQYQRAVEKAEEIFFSVATQLGRYVITMMSSGVVLGVGFQLSGGDSQMNELIWYSWLGGVIIGTMIGANSVLEEHCKAGPRNVVITGSTRGLGKAIAREFLLSGDRVVITSRSPESVLQTIKELEENIQEGLSVAKKKERKTLSHAKVVGTACDVCKPEDVKQLVNFAIDELGSVDIWINNAGTNKGFRPLVTFSDDDITQIVSTNLVGSLLCTREAMNVMQYQEKGGHIFNMDGAGSGGSSTPLTAVYGSTKCGLRQFQASLLKESRRSKVGVHTASPGMVLTDLLLSGSSVRNKQMFNLICELPETVARTLVPRMRVVKGSGKAINYLTPPRILLALVTAWVRRGRWFDDEGRAVYAAEADRIRNWAESRARFSFTDAMEMYTENTWVSVFSLSVVCAFIILSSSGGPLPGT

SEQ ID NO: 5984 - protein, 526 aa, Triticum aestivum
  misc_feature (24)..(24): Xaa can be any naturally occurring amino acid
QYDSTSENRPEREEEHRILISSGXKRAMAAAVVHLSVHGRLRRSPEAVVSQACHRPSLLRCRAFKQEAGGDDEKPSSPPNEPRKRRKGPLYTLKAAMQGLAGSRSAAAEVYGGQYELAVEKAEEIFFSVATQVGRYVITMMSSGVVLAVGFQLSGGDSQTDALIWYSWLGGVIIGTMLGANSVLEEHCKAGPRNVVITGSTRGLGKALAREFLLSGDHVVIASRSPESVLQTINELEENIQEGLSVAKKKQRETLLQAKVVGTSCDVCKPEDVKKLVNFAVGELGSIDIWINNAGTNKGFRPLVNFSDEDITQIVSTNLVGSLLCTREAMDVMQYQEKGGHVFNMDGAGSGGSSTPLTAVYGSTKCGLRQFQASLMKESRRSKVGVHTASPGMVLTDLLLSGSSLQNKQMFNIICELPETVARTLVPRMRVVKGSGKAVNYLTPPRILLALVTAWVRRGRWFDEEGRAVYAAEADRIRNWAESRTRFSFTDAMEMYTENTWVSVFSLSVVCAFIMLSSSGGPFPGT

SEQ ID NO: 5985 - protein, 547 aa, Panicum virgatum
NHWTPTQTRQKVRSAHLRYTQRVSRRRPARRGEIAESFLIHLAAAPWPPPPPSSTSPPTPASASAARRPTRPPPPPAARPSCAAARSSRSLTGGSGTDPTESPNRRKKGPLYKLKAAIQGLAGSRSAAAEAYGGEYQRAVEKAEEIFFSVTTQLGKYVITMMSSGVVLGVGFQLSGGDSQMNELIWYSWLGGVIIGTMIGTNSVLEEHCKAGPRNVVITGSTRGLGKALAREFLLSGDRVVITSRSPESVLQTIKELEENIQEGLSVAKKKERKTLSHAKVVGTASDVCKPEDVKKLVNFAINELGSVDIWINNAGTNKGFRPLVTFSDDDITQIVATNLVGSLLCTREAMNVMQYQDKGGHIFNMDGAGSGGSSTPLTAVYGSTKCGLRQFQSSLLKESRRSKVGVHTASPGMVLTDLLLSGSSLRNKQMFNLICELPETVARTLVPRMRVVKGSGKAINYLTPPRILLALVTAWVRRGRWFDDEGRAVYAAEADRIRNWAESRARFSFTDAMEMYTENTWVSVFSLSVVCAFIILSSSGGPLPGT

SEQ ID NO: 5986 - protein, 331 aa, Zea mays
MVVLAKPPVVDQIPLLRSPGPRDSFSGVPVVDLSSHGAARAIVDACERFGFFKVVNHGVAAATMDRAESEAVRFFAQAQADKDRAGPAYPFGYGSKRIGLNGDMGWLEYLLLAVDAASLSDACPVPSSAAFRSALNEYVAAVRKVAARVLEAMAEGLGIADADALSSMVSGAGSDQVFRVNHYPPCPALQGLGCSTTGFGEHTDPQIISVLRSNGTSGLQIALRDGAQWVSVPSDRDAFFVNVGDSLQVLTNGRFRSVKHRVVTNSLKSRVSFIYFAGPPLGQRIAPLPQVLAEGEESLYKEFTWGEYKKAAYKTRLGDNRLAQFEKRSNI

SEQ ID NO: 5987 - protein, 328 aa, Setaria italica
MVVLANPPVVDQIPLLRSPGPRDSFAAVPVVDLSGPGAARAIVDACERFGFFKVVNHGVAAATMDRAETEAIRFFAQAQADKDRAGPAYPFGYGSKRIGLNGDMGWLEYLLLAVDSASLSDACSVPSNAAFRAALNEYIAAVRKVAVRVLEAMAEGLGIAPLDALSAMVTEQGSDQVFRVNHYPPCPALQGLGCSATGFGEHTDPQLVSVLRSNGTSGLQIALRDGAQWVSVPSDRDAFFVNVGDSLQVLTNGRFKSVKHRVVTNSLKSRVSFIYFGGPPLAQRIEPLPELLGEGEESLYKEFTWGEYKKAAYKTRLGDNRLAQFEKK

SEQ ID NO: 5988 - protein, 338 aa, Zea mays
MVVVLANPPVVDQIPLLRSPGPRDSFSCVPVVDLSGPGAARAIVDACERFGFFKVVNHGVPAATMDVAESEAVGFFAQAQADKDRAGPRASYPFGYGSKRIGLNGDMGWLEYLLLAVDSASLSDACPVPSGAAFRSALNEYVAAVRDVAARVLEAMAEGLGIADAAALSSMVTGAGSDQVFRVNHYPPCPALQGLGCTATATGFGEHTDPQIISVLRSNGTSGLQVALRDAAQAQQWVSVPSDRDAFFVNVGDSLQVLTNGRFESVKHRVVTNSLKSRVSFIYFAGPALEQRIAPLAQLLAEGEESLYREFTWGEYKTAAYKTRLGDNRLAQFQRCSI

SEQ ID NO: 5989 - protein, 194 aa, Panicum virgatum
MVVLANPPVVDQIPLLRSPGPRDSFAAVPVVDLSSPGAARAIVDACERFGFFKVVNHGVAAGTMDRAETEAVKFFAQTQADKGPRGPGLPVRVRQQAHRHQWRHGVARVPPPRRRLRVSLRRLHRPRRRRVPGCVERVHRGGAEGGGARAGGDGGWPGHCARGRAERHGDGAGERPGVPREPLPALPRAPGPGL

SEQ ID NO: 5990 - protein, 326 aa, Triticum aestivum
MVVLASTPAVDHIPLLRSPDPGDYFSGMPVVDLSSPGAPRAIADACERFGFFKLVNHGVPADTMDRLESEAVRFFSLPQADKDRSGPAYPFGYGSKRIGLNGDMGWLEYLLLAVDSASLSGACAVPSCALFRAALNEYIAAVRKVAVRVMEAMAEGLGIAAVDALSGMVTAEGSDQVFRVNHYPPCHALQGLGCSATGFGEHTDPQLISVLRSNGTSGLQIALQNGQWVSVPSDRDAFFVNVGDSLQVLTNGRFKSVKHRVVANSLKSRVSMIYFGGPAMTQRIAPLPQLLGAGEQSLYKDFTWGEYKKAAYNSRLGDNRLAQFHR

SEQ ID NO: 5991 - protein, 327 aa, Oryza sativa
MVVLAGPPAVDHIPLLRSPDPGDVFSGVPVVDLGSPGAARAVVDACERYGFFKVVNHGVATDTMDKAESEAVRFFSQTQPDKDRSGPAYPFGYGSKRIGFNGDMGWLEYLLLALDDASLADACTVPSCAVFRAALNEYISGVRKVAVRVMEAMSEGLGIAQADALSALVTAEGSDQVFRVNHYPPCRALQGLGCSVTGFGEHTDPQLVSVLRSNGTSGLQIALRDGQWVSVPSDRDSFFVNVGDSLQVLTNGRFKSVKHRVVANSLKSRVSFIYFGGPPLAQRIAPLPQLLGEGEQSLYKEFTWDEYKKAAYKSRLGDNRLAQFEKK

SEQ ID NO: 5992 - protein, 326 aa, Triticum aestivum
MVVLASTPAVDHIPLLRSPDPGDYFSGMPVVDLSSPGAPRAIADACERFGFFKLVNHGVPADTMDRLESEAVRFFSLPQADKDRSGPAYPFGYGSKRIGLNGDMGWLEYLLLAVDSASLSGACTVPSCALFRAALNEYIAAVRKVAVRVMEAMAEGLGIAPVDALSAMVTAEGSDQVFRVNHYPPCHALQGLGCSATGFGEHTDPQLISVLRSNGTSGLQIALQNGQWVSVPSDRDAFFVNVGDSLQVLTNGRFKSVKHRVVANSLKSRVSMIYFGGPAMTQRIAPLPQLLGAGEQSLYKDFTWGEYKKAAYNSRLGDNMLAHFHR

SEQ ID NO: 5993 - protein, 326 aa, Brachypodium distachyon
MVVLASPPAADHIPLLRSPDPGDYFSGMPVIDLCSPGAPRAIADACERFGFFKLVNHGVATDAMDRLESEAVTFFSQPQADKDRSGPAYPFGYGSKRIGLNGDMGWLEYLLLAVDDSASLSGAVPSGSAFRRALNEYIGAVRKVAVRVMEAMAEGLGIAPLDALSKMVTAAGSDQVFRVNHYPPCAALQGLGCSATGFGEHTDPQLVSVLRSNGTSGLQIALQDGGQWVSVPSDRDALFVNVGDSLQVLTNGRFKSVKHRVVANSLKSRVSLIYFGGPPLTQRIAPLPQLLGEGEQSLYTEFTWSEYKKAAYKSRLGDNRLAQFQK

SEQ ID NO: 5994 - protein, 326 aa, Hordeum vulgare
MVVLAGTPAVDHIPLLRSPDPGDNFSGMPVVDLSRPGAPRAIADACERFGFFKLVNHGVALDAMDRLESEAVRFFSLPQADKDRSGPAYPFGYGSKRIGLNGDMGWLEYLLLAVDSASLPAASAVPSCALFRAALNEYIAAVRKGAVRVMEAMAEGLGIAQADALSAMVAAEGSDQVFRVNHYPPCHALQGLGCSATGFGEHTDPQLISVLRSNGTSGLQIALQSGHWVSVPSDRDAFFVNVGDSLQVLTNGRFKSVKHRVVANSLKSRVSMIYFGGPALTQRIAPLPQLLREGEQSLYKDFTWGEYKKAAYNSRLGDNRLAHFHR

SEQ ID NO: 5995 - protein, 278 aa, Triticum aestivum
TGPEFSGRPTRPEICTKFTMNDSNKEIVKDIGLIGSNGVPSFVPSPASYLEPPVILNKNKKDDIPNDWVSSLEECQAMSAQKLGQEGSNSGQNCSGSTGDENVSKSKKPASDSTSCEEASSATDKPTRLLAVNGGLVPESSLRPVIGRNSHILKQQKINLLDIDAALPEEALRASKSQQIRRRSWRTFVKHAESISEMVLATSVLESMIKSEFLKNDWWYWSSFTVAMKTSTVSSLALRIYTLDDCIMYTKEPNTMLADSIKVVNKGKRRKEPEPSAS

SEQ ID NO: 5996 - protein, 278 aa, Triticum aestivum
  misc_feature (187)..(187): Xaa can be any naturally occurring amino acid
TGPEFSGRPTRPEICTKFTMNDSNKEIVKDIGLIGSNGVPSFVPSPASYLEPPVILNKNKKDDIPNDWVSSLEECQAMSAQKLGQEGSNSGQNCSGSTGDENVSKSKKPASDSTSCEEASSATDKPTRLLAVNGGLVPESSLRPVIGRNSHILKQQKINLLDIDAALPEEALRASKSQQIRRRSWRXFVKHAESISEMVLATSVLESMIKSEFLKNDWWYWSSFTVAMKTSTVSSLALRIYTLDDCIMYTKEPNTMLADSIKVVNKGKRRKEPEPSAS

SEQ ID NO: 5997 - protein, 270 aa, Triticum aestivum
TRPQGFKQGDSEGYWTYWIKRSPSFVPSRAAFIDPPVILNKNKKQDDIPNDDCVSSSLEECQAMSAHKLGQEGSNSAQDCPAASSSCDENVSKTKEPAPATDTTSCEEAASSATDKPTRLLAVNGGLVPESSLRPVTGRNSHILKQQKINLLDIEAALPEEAFRASKSQQMRRHSWRSFVKRAESISEMVVATSMLEKVIKSEFLKNDWWYWSSFTVAIKTSTLSSLALRIYTLDDCIIYTKEPNTMPPADSTKVVNKGGKGKEPEPSAS

SEQ ID NO: 5998 - protein, 266 aa, Triticum aestivum
GFKQGDSEGYWTYWIKRSPSFVPSRAAFIDPPVILNKNKKQDDIPNDDCVSSSLEECQAMSAHKLGQEGSNSAQDCPAASSSCDENVSKTKEPAPATDTTSCEEAASSATDKPTRLLAVNGGLVPESSLRPVTGRNSHILKQQKINLLDIEAALPEEAFRASKSQQMRRHSWRSFVKRAESISEMVVATSMLEKVIKSEFLKNDWWYWSSFTVAIKTSTLSSLALRIYTLDDCIIYTKEPNTMPPADSTKVVNKGGKGKEPEPSAS

SEQ ID NO: 5999 - protein, 1244 aa, Brachypodium distachyon
MKEADQDKLAAQTLGRYSGVVLPGVHLTLFKVLFGELLSKVAIFVDPNIDPKESKPRRGRKRDTESLNSAKELNFDMLTANKLTWPELARRYLLAVSSISGCMDLSDISSREGVKLFRCLQGDGGILCGALPGVAGMEKDASLLVEAESLICNSSSNEGNKVFMMDYKDTDMIDSAEVPVADNKKLPDWAEPLEPVRKLPTNVGTRIRKCVYEALERKPPEWARKILEQSISKEVYKGNASGPTKKAVLSVLAQACRVIVPQNPENSRKEKKSISISDAILRKCRIALRRAISSDESKFFGNLLGTTLMNSNENEDEGILGFPGMVSRPLDFRTIDIRLAVGAYCGSWETFHEDVQEVIRNLHTAFGDRPDVLDMVVSLSQGFESLYKTEVLDIVQKFDFYLSNGNAGSEIHDELHDILSAATNLPKAPWEDGVCKVCGIDRDDDSVLLCDKCDSEYHTYCLNPPLARIPQGNWYCPSCMSGQKKSHLDQGVKDLKRQQKKHVGEEFHAFHEVLSKLAAAMEEKEYWELSIYERIDLLKFLCDEMLNTALIREHLDQCPDKLSDLQQKFRALNFELKDLKHKEEIRTSYARQSRISKIEQHLSNSSGLVQNKQNDVPTVSGHLEEAEVNLNRPAEGAPPGQLNVDKPCSSGNDMSTIEEYKSLGHSGQPSETVSDWIEGGTIDERSQSCEKRLLDGTISTCENLNLRGTPIAERAPVAPPLIPGGELPDENASTSFQDNLKTSSARSLERDADNDEMDSLSDDVSKLQDSVSIVESQLNMASLRRDCLGKDSLGRLYWVLGRPGKRPLLIADGSMLIRKERNISMVNNYDASLFHKGWNSASIFIYESDEEIRYLVDWLKDYDPRDKELKDAILQWQRHHNHQGGYLRDPPVSILSKNEQLMDLPSTKAAVTYFTSSEYEGHNSGKCNRNSHSPSESKENDELKVKSAKSDIKEKDSLDRSSAIESSSSRKLNSCPYDFEEICRKFVTNDSNKEIVKDIGLIGSNGVPSFVPSPAFFLEPAIILNKDKKDVPDDWTSSLEECQSMSAQQLGQEESKSGQNCPDNTCDENVPKSRKPTPDSTCEASSSVTHKPTSLLAVNGGLVPESSLRPVVGKNSHILKQQKINLLDIDAALPEEALRASKSQQIKRRSWRTFVKDAESICEMVLATSLLESMIRTEFLKNDWWYWSSFTVAMKTSTVSSLALRIYTLDDCIIYAKDPNVEPADNTKVINRGKRRKEPEPSAS

SEQ ID NO: 6000 - protein, 390 aa, Avena sativa
MLIRKERDISMINSYPLSTFDCKGWNSASVFIYESDEEIQGLVDWLREYDPREKELKDAILQWQRHLYHQGSFPLSDPSVHKLSKSDQFMDLPNTKAAVILEQKYGLRVDQDRSDLSRRQGRKTKSGSEERAYRCDCLEPVWPARHHCLTCHETYFTSTDYERHNSGKCNTDNHSPSESKENDEPKVKGPKSDIKEKDSTVVESSSSTKLKSCPYDFEEICRKFVTNDSNKEMVDDIGLIGSNGVPSFVPSPAFFLEPAVILNKNKKDDIPNDLTSSLEECQAMSAQRLVQEGSKSGQNCSGNTGDENVSKSTKPTPDSTSCEEASSATDKPTRLLAVNGGLVPESSLMPVIGRNTHILNRQKINLLDIDAALPEEALRASKSQQIRRRS

SEQ ID NO: 6001 - protein, 571 aa, Triticum aestivum
MEEFISLGGDEPEPRASEDLDQPQVQAQVDLNLNLNHAPPPKTETEPLPSHHQPQDSGVVVLEEGQIACQESSSSAAVQDAQAKAQEEALLRANGVGPPPPSRQQPQATKAAACDDIIDLEEGQVEDMDLSDDNAVVVVVTKQHGAVSAETPKGNNVGPSLSTPSSAFIDQSPTRGVKRARAESTEPSVRVVYNNLTRESKRKLMELMQQWSEWQARKQHASTETVEQVLDCGEETYYPALHVGSERSCAVSFWVDSQARGNAAVDDGAVPLYDREFTLGSTPMGDSSNAEGKKDKDDSRCFNCGSYSHALKDCPKPRDHVAISNARKQHNLKRNLSNVGNRGQNRYYQKTPGKFDDLKAGVLGSETRECLGLRENDPPPWLHRMRELGYPPGYLDEVEDEDKPSGITIFGDGEVKEEQQHEEGELPEKGEPSPPRKRMTVEFPGINAPVPENGDPWLWGSAPPPPLQSSSGRHQHSSSDSRDRAPPAPPGVEHYSSSRYHSYDYGPAIPGAGRRSSSGYDDGAWTPSPAFSSRQHSGSGSGSRERERERERERERERERERDRHYYSNRR

SEQ ID NO: 6002 - protein, 314 aa, Leymus cinereus x Leymus triticoides
  misc_feature (3)..(4): Xaa can be any naturally occurring amino acid
DSXXRENAAVDDGAVPLYDREFTLGSTPMGDSSNAEGKKDKDDSRCFNCGSYSHALKDCPKPRDHVAISNARKQHNLKRNLSNVSNRGQNRYYQKTPGKFDDLKAGVLGSETRECLGLRENDPPPWLHRMRELGYPPGYLDEVEDEDKPSGITIFGDGEAKAEQQHEEGELPEKGEPSPPRKRMTVEFPGINTPVPENGDPWLWGSAPPPPLSSSLGRHQHSSSDSRDRGPPAPPGVEHYSSSRHHSHDYGPATPGAGRRSSSGYEDGAWTPHAAYSSRHYSGSGSRERERERERERERERERHDRHYYSSNRR

SEQ ID NO: 6003 - protein, 558 aa, Triticum aestivum
  misc_feature (411)..(411): Xaa can be any naturally occurring amino acid
  misc_feature (418)..(418): Xaa can be any naturally occurring amino acid
  misc_feature (426)..(426): Xaa can be any naturally occurring amino acid
MEEFISLGASEPGASEGIIDLDHALQVDAVDLNLNLNAQPQGKPSTSTSSLLDIIDLEEGQVASQEASAQHAQGTAADNPHQAKPQQEALGANGGVGPPPSDGVIDLEEGQVEDMDLSDDNALVVVTKQHGRVSAAQTPKANNDGPPLSTLIDQSPTRGVKRARAESTEPSVRVVYNNLTRESKKKLMELMQQWSEWQARKQHASTETVEEVLDCGEETYYPALHVGSERSCAVSFWVDSQARGNAAVDDGAVPLYDREFTLGSTPMGDSSNAEGKKDKDDSRCFNCGSYSHALKDCPKPRDHVAISNARKQHNLKRNLSNVGNRGQNRYYQKTPGKFDDLKAGVLGSETRECLGLRENDPPPWLHRMRELGYPPGYLDEVEDEDKPSGITIFGDGEVKEEQQQQEEGELXEKGEASXPRKRMTVXFPGINAPVPENGDPWLWGSAPPPPLQSSSGRHNQHSSSDSRDRAPPAPPGVEHYSSSRYHSYDYGPAIPGAGRRSSSGYDDGAWTPSPSFSSRQHSGSGSGSRERERDWERERERERERDRERDRHYYSNRR

SEQ ID NO: 6004 - protein, 327 aa, Pseudoroegneria spicata
EHRSSLRHLRHLLSSLSSRVILSLVPPVSAFTAFAAAVATYNTLAPDYALTASSLPYQLTAPALALLLVFRTEASYARFDEGRKAWMRVLAGATELAGMVMHSCGGGGERGDNETGRGALVNYILAFPVALKCHITSNSDIRKDLQGLLAEDDLNVIMSSKHRPRCIIEFISQSLQILDFEEHKRSIMESKLSCFLEGICVCEQIIGIPVPLSYTRLTSRFLVLWHLTLPIILWAECKWIVVPATFVSAASLFCIEEVGVLIEEPFPMLALDAQCQQLHDSMRDMMSVQGLVRKQLVAKTKGRGRGGRLPQNGWPVSSSRSEQVKVD

SEQ ID NO: 6005 - protein, 240 aa, Triticum aestivum
MRVLAGATELAGMVMHSCGAGERGDNDTGTGALVNYILAFPVALKCHITSNSDIRKDLQGLLAEDDLNVIMSSKHRPRCIIEFISQSLQMLDFEEHKRSIMESKLSCFLEGICVCEQIIGIPVPLSYTRLTSRFLVLWHLTLPIILWAECKWIVVPATFVSAASLFCIEEVGVLIEEPFPMLALDAQCQQLHDSMRDMMSVQGLVRKQLVAKTKGHGRGGRLPQNGWPVSSSRGEQVKVD

SEQ ID NO: 6006 - protein, 149 aa, Tragopogon dubius
VWSVGCIFMELMNRKPLFPGKDHVHQMRLLTELLGTPSESDLGFIKNEDARRYICQLPRHPRKSLLNTFPHVHPSAIDLVEKMLTFDPAKRITVEEALEHPYLERLHDVEDEPICENPFSFDFEQKVLGEEQIKELIYEEALAHNLDHA

SEQ ID NO: 6007 - protein, 134 aa, Zinnia violacea
TLFAGKDHVHQMRLLTELLGTPSESDVGFIKNKDAIRFISQLPRHPRKSLPKTFPHVHPLAIDLVEKMLTFDPAKRITVEEALAHPYLERLHDIEDEPTCPNPFSFDFEQQVLGEEQIKDLIYQEALAHNPEYA

SEQ ID NO: 6008 - protein, 377 aa, Pennisetum glaucum
AVTLTSAETGPPLVQRCKKIDSLRAINGAPPCIPVSDRSPLAPVTLPVFQDPGMRNDNTRLRIFSGTANPSLSQEIASYLGLELGKINIKRFADGEIYVQLQESVRGCDVFLVQPTCPPANENLMELLIMIDACRRASAKNITAVIPYFGYARADRKSQGRESIAAKLVANMITEAGANRVLVCDLHSSQAMGYFDIPVDHVYGQPVILDYLASKTICSNDLVVVSPDVGGVARARAFAKKLSDAPLAIVDKRRHGHNIAEVMNLIGDVRGKVAVMMDDMIDTAGTIAKGAELLHQEGAREVYACCTHAVFSPPAIERLSSGLFQEVIITNTIPLKEEKSFPQLTILSVANLLGETIWRVHDDCSVGHEPYSSLDID

SEQ ID NO: 6009 - protein, 391 aa, Fragaria vesca
MASLLHSPPLSSRTLLPPYSSPSPSFPTRFRCSVGEPLKYANGKPSIPLLRSDEMVPNFLTRHALTTATKDDTRLRIFSGTANPSLSQEIACYMGLELGKIKIKRFADGEIYVQLQESVRGCDVYLVQPTCPPANENLMELLIMIDACRRASAKNITAVIPYFGYARADRKTQGRESIAAKLVANLITEAGANRVLACDLHSGQSMGYFDIPVDHVYGQPVILDYLASKTICSDDLVVVSPDVGGVARARAFAKKLSDAPLAIVDKRRHGHNVAEVMNLIGDVKGKVAVMVDDMIDTAGTISKGAELLHQEGAREVYACSTHAVFSPPAIERLSSGLFQEVIITNTIPVSEQNYFPQLTVLSVANLLGETIWRVHDDCSGGFEPYSTLGID

SEQ ID NO: 6010 - protein, 388 aa, Gossypium hirsutum
MASSSLLWLCSSNPLISPATHLKAHPRFPIRHRFRCSLVEPLKFENGKPHFPLLTSDPAFPTFLSPNSHFQNDINKHDTRLRIFSGTANPALAQEIACYMGLELGKIKIKRFADGEIYVQLQESVRGCDVFLVQPTCPPANENLMELLIMIDACRRASAKNITAVIPYFGYARADRKTQGRESIAAKLVANLITEAGANRVLACDLHSGQSMGYFDIPVDHVYGQPVILDYLASKTICSDDLVVVSPDVGGVARARAFAKKLSDAPLAIVDKRRHGHNVAEVMNLIGDVKGKVAVMVDDMIDTAGTIAKGAALLHQEGAREVYACSTHAVFSPPAIERLSSGLFQEVIITNTIPVSEQNYFPQLTVLSVANLLGETIWRVHDDCSGGV

SEQ ID NO: 6011 - protein, 402 aa, Malus domestica
MASLLHTVSPSPLASRNSLHTRAYIPNFSRSRVPVPNAVRCGVGEPLKYANGKPCVPLLRSEDLVPTFSDTKTHLVNEISKNDTRLRIFSGTANPALSQEIACCMGLELGRIKIKRFADGEIYVQLQESVRGCDVYLVQPTCPPANENLMELLVMIDACRRASAKNITAVIPYFGYARADRKTQGRESIAAKLVANLITEAGANRVLACDLHSGQSMGYFDIPVDHVYGQPVILDYLASKTIYSDDLVVVSPDVGGVARARAFAKKLSDAPLAIVDKRRHGHNVAEVMNLIGDVKGKVAVMVDDMIDTAGTITKGAALLHQEGAREVYACCTHAVFSPPAIERLSSGLFQEVIITNTIPVSEQNYFPQLTVLSVANLLGETIWRVHDDCSGGYEPYSTLGID

SEQ ID NO: 6012 - protein, 399 aa, Manihot esculenta
MASLLHLSTTISTSFHRSSSFFSKEPRFPLGHGVRCNLVEPLKFENGKPCIQLLSPSEQSFPSFLASKSHLGNAIPSRHDTRLRIFSGTANPALSQEIASYMGLELGKIKIKRFADGEIYVQLQESVRGCDVYLVQPTCPPANENLMELLIMIDACRRASAKNITAVIPYFGYARADRKTQGRESIAAKLVANLITEAGANRVLACDLHSGQSMGYFDIPVDHVYGQPVILDYLASKTICSDDLVVVSPDVGGVARARAFAKKLSDAPLAIVDKRRHGHNVAEVMNLIGDVKGKVAVMVDDMIDTAGTITKGAALLHQEGAREVYACSTHAVFSPPAIERLSSGLFQEVIITNTIPVSEQNYFPQLTVLSVANLLGETIWRVHDDCSGGFEPCSSLGID

SEQ ID NO: 6013 - protein, 406 aa, Phaseolus coccineus
KTSKRHVHSAPSLRSHSFTFLRSDHFFSLLLTSRISLPNAVCCKAIEAVQLENGRPSAREFAARGNAIPSYVEAPNARIRNLVNRNDTRLRIFSGTANPALSQEIACYLGLELGKIKIKRFADGEIYVQLQESVRGCDVFLVQPTCPPANENLMELLIMIDACRRASAKNITAVIPYFGYARADRKTQGRESIAAKLVANLITEAGANRVLACDLHSGQSMGYFDIPVDHVYGQPVILDYLASKTICSDDLVVVSPDVGGVARARAFAKKLSDAPLAIVDKRRHGHNVAEVMNLIGDVRGKVAVMVDDMIDTAGTIAKGAALLHQEGAREVYACTTHAVFSPPAIERLSSGLFQEVIITNTIPVAEQNYFPQLTVLSVANLLGETVWRVHDDCSGGIEPYSSLGID

SEQ ID NO: 6014 - protein, 404 aa, Quercus alba
MSSLLHHSYCSSSPLTSRSYLKLNFFPSSRIPASQNGVRCNLVEPLKFENGKPYTPYLSSSTTTDQATATTPSISNAPYSENAHDTRLRIFSGTANPALSQEIACYMGLELGKIKIKRFADGEIYVQLQESVRGCDVYLVQPTCPPANENLMELLIMIDACRRASAKNITAVIPYFGYARADRKTQGRESIAAKLVANLITEAGANRVLACDLHSGQSMGYFDIPVDHVYGQPVILDYLASKYICSDDLVVVSPDVGGVARARAFAKKLSDAPLAIVDKRRHGHNVAEVMNLIGDVKGKVAVMVDDMIDTAGTISKGAVLLHQEGAREVYACSTHAVFSPPAIERLSSGLFQEVIITNTIPVSEQNYFPQLTILSVANLLGETIWRVHDDCSGGFEPYSSLGID

SEQ ID NO: 6015 - protein, 402 aa, Vigna unguiculata
  misc_feature (34)..(35): Xaa can be any naturally occurring amino acid
NAMSTPYLHSAPTPSPSFSPITTSRFFQTSRVAXXNAVRCKAIEAVQLENGRPSASEVAGGNAIPSYVVAPNARIRDLVHRNDTRLRIFSGTANPALSQEIACYLGLELGKIKIKRFADGEIYVQLQESVRGCDVFLVQPTCPPANENLMELLIMIDACRRASAKNITAVIPYFGYARADRKTQGRESIAAKLVANLITEAGANRVLACDLHSGQSMGYFDIPVDHVYGQPVILDYLASKTICSDDLVVVSPDVGGVARARAFAKKLSDAPLAIVDKRRHGHNVAEVMNLIGDVRGKVAVMVDDMIDTAGTIAKGAALLHQEGAREVYACTTHAVFSPPAIERLSSGLFQEVIITNTIPVAEQNYFPQLTVLSVANLLGETVWRVHDDCSGGIEPYSSLGID

SEQ ID NO: 6016 - protein, 402 aa, Malus domestica
MASLLHTASRSSLASRDSLRHRTYLPNYSRSQIPILNSVRCGVGEPLKYANGKPCVPLLRSEDLVPTFSDTKTHLVNEISKNDTRLRIFSGTANPALSQEIACCMGLELGRIKIKRFADGEIYVQLQESVRGCDVYLVQPTCPPANENLMELLVMIDACRRASAKNITAVIPYFGYARADRKTQGRESIAAKLVANLITEAGANRVLACDLHSGQSMGYFDIPVDHVYGQPVILDYLASKTIYSDDLVVVSPDVGGVARARAFAKKLSDAPLAIVDKRRHGHNVAEVMNLIGDVKGKVAVMVDDMIDTAGTITKGAALLHQEGAREVYACCTHAVFSPPAIERLSSGLFQEVIITNTIPVSEQNYFPQLTVLSVANLLGETIWRVHDDCSGGYEPYSTLGID

SEQ ID NO: 6017 - protein, 401 aa, Triphysaria pusilla
MASLAVSRSWLTNPLKTYHHATPNITPITLCNNMSLETLKGKENGRPITASRDYSRQATAAFPSFLTSPNQILDGISIPQNCTRLRIFSGTANPSLSQEIACYMGLELGKIKIKRFADGEIYVQLQESVRGCDVYLVQPTCPPANENLMELLIMIDACRRASAKNITAVIPYFGYARADRKTQGRESIAAKLVANLITEAGADRVLACDLHSGQSMGYFDIPVDHVHGQPVILDYLASKTIRTDDLVVVSPDVGGVARARAFAKKLSDAPLAIVDKRRHGHNVAEVMNLIGDVRGKVAVMVDDMIDTAGTIAKGAALLHQEGAREVYACSTHAVFSPPAIERLSSGLFQEVIITNTIPVAEHNYFPQLTILSVANLLGETIWRVHDDCAGGFEPYSSLGID

SEQ ID NO: 6018 - protein, 401 aa, Populus trichocarpa
MASLLQCPTSPFPSSFSSNNPRSPFLRFHFPLRHAVRCNLVEPIKFANGKPYIPLLNTSAHHLSSTATSHLDNTLPPFNKHDTRLRIFSGTANPALSQEIACYMGLELGKIKIKRFADGEIYVQLQESVRGCDVFLVQPTCPPANENLMELLIMIDACRRASAKNITAVIPYFGYARADRKTQGRESIAAKLVANLITEAGANRVLACDLHSGQSMGYFDIPVDHVYGQPVILDYLASKTICSDDLVVVSPDVGGVARARAFAKKLSDAPLAIVDKRRHGHNVAEVMNLIGDVKGKVAVMVDDMIDTAGTITKGAALLHQEGAREVYACTTHAVFSPPAIERLSSGLFQEVIITNTIPVSEQNYFPQLTVLSVANLLGETIWRVHDDCSGGIEPYSSLGID

SEQ ID NO: 6019 - protein, 395 aa, Eucalyptus grandis
MASLICSPLKSSLSCGSSVRFPCFSSSEPASRLLVHNGIRCNLVEPLKLHNGKPCLPVINNEGSLPSFLTSTHPQNSINKNDTRLRIFSGTANPALSQEIACYMGLELGKIKIKRFADGEIYVQLQESVRGCDVFLVQPTCPPANENLMELLIMIDACRRASAKNITAVIPYFGYARADRKTQGRESIAAKLVANLITEAGANRVLACDLHSGQSMGYFDIPVDHVYGQPVILDYLASKTICSDDLVVVSPDVGGVARARAFAKKLSDAPLAIVDKRRQAHNVAEVMNLIGDVKGKVAVMVDDMIDTAGTIAKGAALLHQEGAREVYACTTHAVFSPPAIERLSSGLFQEVIITNTIPVSEQNYFPQLTVLSVANLLGETIWRVHDDCSVSSIFQ

SEQ ID NO: 6020 - protein, 402 aa, Prunus persica
MTSLLHPASPFSLASRESLRTRTFLPNRSCSRIAAPNGVRCNVGDPLKYANGKPSTPLLKTEEMAPNFLATETHLVNATTKNDTRLRIFSGTANPALSQEIACNMGLELGKIKIKRFADGEIYVQLQESVRGCDVYLVQPTCPPANENLMELLIMIDACRRASAKNITAVIPYFGYARADRKTQGRESIAAKLVANLITEAGANRVLACDLHSGQSMGYFDIPVDHVYGQPVILDYLASKTICSDDLVVVSPDVGGVARARAFAKKLSDAPLAIVDKRRHGHNVAEVMNLIGDVKGKVAVMVDDMIDTAGTITKGAALLHQEGAREVYACSTHAVFSPPAIERLSSGLFQEVIITNTIPVSEQNYFPQLTVLSVANLLGETIWRVHDDCSGVLEPFSTLGID

SEQ ID NO: 6021 - protein, 396 aa, Tripterygium wilfordii
QASSSAFTCFPTSLFSKDHFFRFRQHSHPLVVRCCNLVEPLKFENGKPQLPLLDSQPAFPSFLLSSTHLHSSENKHDTRLRIFSGTANLALSQEIACYMGLELGKIKIKRFADGEIYVQLQESVRGCDVYLVQPTCPPANENLMELLIMIDACRRASAKTITAVIPYFGYARADRKTQGRESIAAKLVANLITEAGANRVLACDLHSGQSMGYFDIPVDHVYGQPVILDYLASKTICSDDLVVVSPDVGGVARARAFAKKLSDAPLAIVDKRRHVHNVAEVMNLIGDVKGKVAVMVDDMIDTAGTIAKGAALLHQEGAREVYACTTHAVFSPPAIERLSSGLFQEVIITNTIPVSEKNYFPQLTVLSVANLLGETIWRIHDDCSGGFEPYSSLGID

SEQ ID NO: 6022 - protein, 383 aa, Triticum aestivum
MRARDAVSRGADSSSNTKVFASKKSAEKKGFKGLSNPDSSGHGTRTVQKRSAKKVAGRQKECFVERQVDSRGPHTHQQQQLNREEKVNVNDGTNQELFPLIPPGFKSICNGQGLPPPGFKSICNGQGLLDGEKVDERPNQLHIQDAGSSQCTMENTALRSCSAVGTSLHPPFLSCQISGERFPFIKTSSIWHQIEPMEVFRKVPQEPHFLPLQQFMPELREGMAIGLMVTYASLVESVKRSCIEDNIELFERKINALAHLEENGFDVKLLQHSLMKLLEAKWEHTKHLGHLDELKELVPRKESAMSHKHALLVEKEGAIFQLEQKLECLRGEAEQIARETKDEDAELLRLKEGVNIAQEACVNVEVRFHDILADMRSRLQLSE

SEQ ID NO: 6023 - protein, 383 aa, Triticum aestivum
  misc_feature (115)..(115): Xaa can be any naturally occurring amino acid
  misc_feature (124)..(124): Xaa can be any naturally occurring amino acid
  misc_feature (148)..(148): Xaa can be any naturally occurring amino acid
MRARDAVSRGADSSSNTKVFASKKSAEKKGFKGLSNPDSSGHGTRTVQKRSAKKVAGRQKECFVERQVDSRGPHTHQQQQLNREEKVNVNDGTNQELFPLIPPGFKSICNGQGLXPPGFKSICXGQGLLDGEKVDERPNQLHIQDAGXSQCTMENTALRSCSAVGTSLHPPFLSCQISGERFPFIKTSSIWHQIEPMEVFRKVPQEPHFLPLQQFMPELREGMAIGLMVTYASLVESVKRSCIEDNIELFERKINALAHLEENGFDVKLLQHSLMKLLEAKWEHTKHLGHLDELKELVPRKESAMSHKHALLVEKEGAIFQLEQKLLCLRGEAEQIAKETKDEDAELLRLKEGVNIAQEACVNVEVRFHDILADMRSRLQLSE

SEQ ID NO: 6024 - protein, 529 aa, Zea mays
AFCFFQNNDDSCLAYVLGAISNLLSKIGISNTVGIISSPYSLGTNIGLGTPLSIQQQLLVLLKRSLKRADALKLPSLLSFDHLSLAKFDLKHVQRPLVSFGPNASTKLRTCPADVCKNLRLGSRVLTDFGADVLSTSNDNGSFSTSWLRNLSATSDSWRSSSKNTKKIHINDFDNFHYHAQPSPVPASILQLAGSAYLLRATAWEHYGSAPMVRMNVLVYATCFADAASSSELSLAYVKLIQQLAVFKGYSAAFCALKLAEKKFPSSTSLHIQLLGMQILHERALHRGHLKVAQQICDEFGVLSSSVSGVDIELKTEFSVRRARTLLAAKQFSQAAAVANSLFSTCYKYNMQVENASVLLLLAEIHKKSDNAVLGLPYALASQSFCKSFNLDLLEASATLTLAELWLDLGSSHAKKALSLVYQSLPMILGHGGLELRARAHVVLAKCHLSDLKFSVLEDPEAVLDPLNQATEDLQALEYHEMAAEAYYLKAMAYNHLGKLDEREEAAARFKDHVTALETPHNEEDSLKY

SEQ ID NO: 6025 - protein, 493 aa, Panicum virgatum
SVRHITLGTNIGLGTPLSIQQQLLVLLKRSLKRADILKLASLLSFDHLSLAKFDLKHVQRPLVSFGPNASTKLRTCPADVCKNLRLSTRVLTDFGTDALSTSNDNGSFSTSWLRNLSAASDSWHSSSMKSTKLHNDFDNFHYHAQPSLVPAPVLQLAGSGYLLRATAWEHYGSAPMVRMNALVYATCFADAASSSELSLAYVKLIQQLAVFKGYSAAFCALKLAEKKFPSSTSLHIQLLRMQILHERALHRGHLKVAQQICDEFGVLSSSVSGVDIELKIEASVRRARTLLAAKQYSQAAAVANSLFSTCYKYNMQVENASVLLLLAEIHRKSDNAVLGLPYALATQSFCKSFNLDLLEASATLTLAELWLALGSSHAKRALSLAHQSLPMILGHGGLELCARAHIVLAKCHLSDPEFSVFEKPEAVLDPLNQATQDLQVLEYREMAAEAYYLKAMAYNHLGKLDEREEAAGCFKEHITALENPHNEEDSLAY

SEQ ID NO: 6026 - protein, 384 aa, Triticum aestivum
VLDVGCGVASFSAYLLPLDIHTMSFAPKDGHENQIQFALERGIGAMISVLATKQLPYPGNSFEMVHCSRCRVDWHENDGILLKEVDRLLRPNGYFVYSAPPAYRKDKDFPIIWERLINITSAMCWKLIAKHVQTAIWIKPEDESCRQKNSDTGILNICDPSDTSSWQAPLMNCIRLNTDQSKIQKLPSRPERLLFYSRSLEIIGVTPEKFENNNQFWRDQVRKYWSFLGVEKTSIRNIMDMNANYGGFAMALSTDPVWIMNIVPYTTINTLPAIYDRGLIGSYHDWCQPFSTYPRSYDLLHAFHLFSHYQGHVGGCLLEDIMLEIDRIIRPQGFIIIRDENTTLSRISDLAPKFLWDVTTHTLENEENRPEQVLICRKKFWAIV

SEQ ID NO: 6027 - protein, 362 aa, Triticum aestivum
  misc_feature (134)..(134): Xaa can be any naturally occurring amino acid
  misc_feature (146)..(146): Xaa can be any naturally occurring amino acid
  misc_feature (152)..(152): Xaa can be any naturally occurring amino acid
  misc_feature (159)..(159): Xaa can be any naturally occurring amino acid
MSFAPKDGHENQIQFALERGIGAMISVLATKQLPYPGNSFEMVHCSRCRVDWHENDGILLKEVDRLLRPNGYFVYSAPPAYRKDKDFPIIWERLINITSAMCWKLIAKHVQTAIWIKPEDESCRQKNSDTGILXICDPSDTSSWQXPLMNCXRLNTDQXKIQKLPSRPERLLFYSRSLEIIGVTPEKFENNNQFWRDQVRKYWSFLGVEKTSIRNIMDMNANYGGFAMALSTDPVWIMNIVPYTTINTLPAIYDRGLIGSYHDWCQPFSTYPRSYDLLHAFHLFSHYQGHVGGCLLEDIMLEIDRIIRPQGFIIIRDENTTLSRISDLAPKFLWDVTTHTLENEENRPEQVLICRKKFWAIV

SEQ ID NO: 6028 - protein, 369 aa, Saccharum officinarum
LDIQTMSFAPKDGHENQIQFALERGIGAMISVLATKQLPYPESSFEMVHCSRCRVDWHENDGILLKEVDRLLRPNGYFVYSAPPAYRKDKDFPVIWEKLVNITTALCWKLIAKHVQTAIWVKPEDESCRQRKADMKLLNICESNDNVSPSWKIPLMNCVKLNKDKSNIQKLPSRSDRLSFYFKSLEMIGVTPERFEKNNQFWKNQVHKYWSFLGIEKTSIRNVMDMNANYGGFAAALSSDPVWIMNIVPHTMTNTLPIIYDRGLLGSYHDWCEPFSTYPRSYDLLHAFHLFSHYEGHKEDCLLEDIMLEMDRIIRPQGFVIIRDENHTLSRIIDLAPKFLWDVTVHMLKNEESGTDQVLFCRKKFWAIV

SEQ ID NO: 6029 - protein, 246 aa, Panicum virgatum
  misc_feature (71)..(71): Xaa can be any naturally occurring amino acid
  misc_feature (88)..(88): Xaa can be any naturally occurring amino acid
EDESCRQKNADMKLLNICESNDNVSPSWKIPLMNCVRLNKDKSEIQKLHSRPDRLSFYFKSLEMIGVTPAXFEKNNEFWKKQVHKYWXLLDVEKNSVRNVMDMNANYGGFAAALSNDPVWIMNVVPYTMSNTLPVIYDRGLLGSYHDWCEPFSTYPRSYDLLHAFHLITHYESRNEDCSLEDIMLEMDRIIRPQGLIIIRDDKNTLSRIIDLAPKFLWDVSTHMLENEENGTELVLICRKKFWAIV

SEQ ID NO: 6030 - protein, 556 aa, Oryza sativa
MTRGRTRWRRRRSWWSGGILRRRGIGWCSIRRRTRGITWALQAAMARLEDEFRHLLARGMSPLAGEDLHASLLRRLSLTVPSFASSASDLDCPSFASHTGDGDESGGAGGRASVSDEEISPYLISPDTVGALRGIADVMLRAGYGPELCQVYGEMRRDTLMECLAVLGVDKMSLEEVQRVEWGVLDGKMKKWIQALKVVVRGLVAEERRICNQIFAADAEAEEDCFTEAAKGCVLQLLNFGDAIAIGKRSSEKLFRILGMYEALDEVLPELEGLFSGDARDFIKEEAVGILMRLGDAVRGTVAEFANAIQGETSRRALPGGEIHPLTRYVMNYVRLLADYSRSLNQLLKDWDTELENGGDNVNMTPLGQCVLILITHLQAKIEEKSKLYEDEALQNIFLMNNLLYIVQKVKDSELKTLLGDNWIRQRRGQIRRYSTGYLRSSWTRVLACLRDDGLPQTMGSSSALKASLKERFKNFNLAFEELYKTQTTWKVVDPQLREELKISISEKVLPAYRSFVGRFRGQLEGGRNSARYIKYNPEDLENQVSDFFEGRRPNA

SEQ ID NO: 6031 - protein, 658 aa, Sorghum bicolor
MAAAPPPDGQEKVIAAAQHIVKSLASSKNAADDMIRILSGFDNRLSLMSDLFPPPPPSAAPVDSILEADEGTSQGDGDDPDEDDAVARAEARWDAAADVIERWESPAAGDALVFDSREDAEEYLAAAACVAGAPGPRADAALQAAMARLEDEFRHLLVRGAPPLAAEDLQASLLRRLSLTVPSFNSSAVDLDCPSFAQHHASAAEGGDEQQGGRSSASDDEISPYLIAPDTVSALRDIADVMLRAGYAPELCQVYGEVRRDTLMECLAVLGVDKMSLEEVQRVEWGVLDGKMKKWIQALKVVVRGLLAEERRICSQILAADPNAEEECFTEAAKGCVLQMLNFGDAIAIGKRSTEKLFRILGMYEALAEVLPELEGLFSGEAKDFIKEEAEGILARLGDAVRGTIEEFANAIQGETSRRPLPGGEIHPLTRYVMNYVRLLADYNASLNKLLECWDTELTGVDNPNMTPLGHCVLMLITHLQCKIDEKSRLYEDEALQNIFLMNNLLYIVQKVKDSELKTLLGDNWIRKRRGQIRQYSTGYLRSSWTRVLACLRDDGLPHTMGSSSQLKAALKDRFKNFNLAFEELYRTQTSWRVVDPQLREELKISISEKVLPAYRSFVGRFRGQLEGGRGSARYIKYNPDDLENQVSDFFEGRKPNA

SEQ ID NO: 6032 - protein, 418 aa, Triticum aestivum
MLRAGYGPELCQVYSEVRRDTLMECLAVLGVDKMSLEEVQRVEWGVLDGKMKKWIQALRVVVQGLLAEERRICGQILAADADAEEECFTEAAKGCVLQLLNFGDAIAIGKRSSEKLFRILGMYEALAELLPELEALFSGDARDFIKEEAEGILVRLGDAVRGTVAEFANAIRGETSRRSLPGGEIHPLTRYVMNYVRLLADYSRWLNHLLDGCETELENGGDNADMTPLGHCLLILITHLLDKIEDKAKLYDDEALQNIFLMNNLWYVVQKIKDSELKSLLGDNWIRKRRGQIRRYSTGYLRSSWTRVLACLRDDGLPQTTGSSSALKAALKERFKSFNLAYEELYRTQTAWKVVDPQLREELKISISEKVLPAYRSFVGRFRGQLEGGRNFAKYIKYNPEDVENQVSDFFEGKKLNA

SEQ ID NO: 6033 - protein, 248 aa, Leymus cinereus x Leymus triticoides
  misc_feature (153)..(153): Xaa can be any naturally occurring amino acid
  misc_feature (186)..(186): Xaa can be any naturally occurring amino acid
  misc_feature (188)..(188): Xaa can be any naturally occurring amino acid
  misc_feature (210)..(210): Xaa can be any naturally occurring amino acid
ITDILIEWGMPVTMRSIHPIYFAKCLTKAVNDNHGEKIVNPSNRVSILGYLRPAFIEEESYLRSLFHSECNADGYSSDWREEYNREPRPASGTNGLIDGDKSRLDINDVGSSIDSTIYKLEMMTIELFSIYGKQFMIDPQDFQDAEPDLLSNXASDIIKRIKENSDQCTTALRSLCSRKKGLTVEXAXLIGVDSLGIDVRAFSGLEARTXRFSFNAQALSERSAEKKIKRMLFPRYRKTVKASAEDEC

SEQ ID NO: 6034 - protein, 790 aa, Triticum aestivum
MSAIQSYTRPVSIGTQGYESVGQGTAVGQPMVHMSAILQVTGEAEYVDDTPTPPNILHAALVLSKKAHARILSIDDSVAKCSPGFAGLFLSKDVPGSNHIGPIIHDEEVFASDVVTCVGQIIGIVVADTHDNAKAAANKVNIEYSELPAILSISEAVKAGSFHPNTTRCLSNGDVEQCFASNTCDKIIEGEIRVGGQEHFYMEPQCTFVWPVDSGNEIHMISSTQAPQKHQKYVANALGLPLSKVVCKTKRIGGGFGGKETRSAIFAAAASVASYCLRRPVKIVLDRDVDMITTGQRHSFLGKYKLGFTNDGKIQALDLEIYNNGGNSLDLSLAVLERAVFHSENVYAIPNIRVSGKVCFTNFPSNTAFRGFGGPQGMLIAENWIHHMATELKRSPEEIKELNFQSEGTELYYGQLLKNCTMHSVWDELKASCNILEARKAVNVFNSENRWRKRGIAMVPTKFGISFTAKFMNQAGALVQVYTDGTVLVTHGGVEMGQGLHTKIAQVAASSLDIPLSCVFISETSTDKVPNASPTAASASSDLYGAAVLDACQQIKARMEPIASRGNHKSFAELAQACYMERVDLSAHGFYITPDIGFDWIAGKGSPFNYFTYGAAFAEVEIDTLTGDFHTRTADIVMDLGYSINPAIDIGQIEGAFIQGLGWAAMEELKWGDDNHKWIRPGYLFTCGPGSYKIPSVNDIPLNFKVSLLKGVPNPRAIHSSKAVGEPPFFLASAILFAIKDAIAAARAEEGHLDWFPLDNPATPERIRMACVDSITKKFACVYYRPKLSV

SEQ ID NO: 6035 - protein, 790 aa, Triticum aestivum
  misc_feature (56)..(56): Xaa can be any naturally occurring amino acid
MSAIQSYTRPVSIGAQGYESVGQGTAVGQPMVHMSAILQVTGEAEYVDDTPTPPNXLHAALVLSKKAHARILSIDDSVAKCSPGFAGVFLSKDVPGSNHIGPIIHDEEVFASDVVTCVGQIIGIVVADTHDNAKAAANKVNIEYSELPAILSISEAVKAGSFHPNTTRCLSNGDVEQCFASNTCDKIIEGEIRVGGQEHFYMEPQCTFVWPVDSGNEIHMISSTQAPQKHQKYVANALGLPLSKVVCKTKRIGGGFGGKETRSAIFAAAASVASYCLRRPVKIVLDRDVDMITTGQRHSFLGKYKLGFTNDGKIQALDLEIYNNGGNSLDLSLAVLERAVFHSENVYAIPNIRVSGKVCFTNFPSNTAFRGFGGPQGMLIAENWIHHMATELKRSPEEIKELNFQSEGTELYYGQLLQNCTMHSVWDELKASCNILEARKAVNVFNSENRWRKRGIAMVPTKFGISFTAKFMNQAGALVQVYTDGTVLVTHGGVEMGQGLHTKIAQVAASSLDIPLSCVFISETSTDKVPNASPTAASASSDLYGAAVLDACQQIKARMEPIASRGNHKSFAELAQACYMERVDLSAHGFYITPDIGFDWIAGKGSPFNYFTYGAAFAEVEIDTLTGDFHTRTADIVMDLGYSINPAIDIGQIEGAFIQGLGWAAMEELKWGDDNHKWIRPGYLFTCGPGSYKIPSVNDIPLNFKVSLLKGVPNPRAIHSSKAVGEPPFFLASAILFAIKDAIAAARAEEGHLDWFPLDNPATPERIRMACVDSITKKFACVYYRPKLSV

SEQ ID NO: 6036 - protein, 605 aa, Setaria italica
RIISGEVQVGGQEHFYMEPQGTLVWPVDSGNEIHMVSSTQAPQKHQKYVANVLGLPLSKVVCKTKRIGGGFGGKETRSATFAAAVSVPSYRLRRPVKLILDRDVDMISSGQRHSFLGRYKVGFTNDGKVLALDLELYNNGGNSLDLSRAVLERAMFHSENVYDIPNIRISGQVCLTNFPSNTAFRGFGGPQGMLITENWIHHIASELQRSPEDIKELNFHDDGTVLHYGQLLQNCRIRSVWDELKASCNFVEARKAVRSFNSNNRWRKRGIAMVPTKFGISFTSKFMNQAGALVQVYTDGTVLVTHGGVEMGQGLHTKVAQVAASSFNIPLSSVFISETSTDKVPNASPTAASASSDLYGAAVLDACQQIKARMEPIASRGTHNSFAELAQTCYMERVDLSAHGFYATPDIGFDWTNGKGTPFLYFTYGAAFAEVEIDTLTGDFHTRTADIVMDLGFSINPAIDIGQIEGAFIQGLGWVAMEELKWGDNNHKWIRPGHLFTCGPGAYKIPSVNDIPLNFKVSLLKGAPNPKVIHSSKAVGEPPFFLGSAVLFAIKDAIFAARADEGHSEWFPLDNPATPERIRMACVDSITKKFADADYRPKLSV

SEQ ID NO: 6037 - protein, 886 aa, Pennisetum glaucum
KWVISDVSIVYGGVAAVPLSASKTENFLIGKKWNSELLDDTFNLLKEDIPLSENAPGGMVEFRRSLTLSFLFKFFLSVTHDMNMKGFLEDGLHADHVSAIQPYSRPVTVGTQGYEMVRQGTSVGQPMVHMSAMLQVTGEAEYTDDTPTPPNTLHAALVLSRKAHARILSIDDSIAKSSPGFVGLFLSKDIPGTNHTGPIIHDEEVFASDVVTCVGQIIGIVVADTHDNAKNAANKVHIEYSELPAILSIEDAVKSGSFHPNTKRCLGKGDVEQCFMSGACDRIISGEVQVGGQEHFYMEPQGTLVWPVDSGNEIHMVSSTQAPQKHQKYVANVLGLPLSKVVCKTKRIGGGFGGKETRSAIFAAAVSVPSYHLRRPVKLILDRDVDMISSGQRHSFLGRYKVGFTNDGKILALDLELYNNGGNSLDLSLAVLERAMFHSENVYDIPNIRISGQVCFTNFPSNTAFRGFGGPQGMLITENWIHHIASELQQSPEDIKELNFHNDGTVLHYGQLLQNCRIRSVWDELKASCNFVEARKGIRSFNSNNRWRKRGIAMVPTKFGISFTSKFMNQAGALVQVYTDGTVLVTHGGVEMGQGLHTKVAQVAASSFNIPLSSVFISETSTDKVPNASPTAASASSDLYGAAVLDACQQIKARMEPIASRGTHNSFAELAQTCYMERVDLSAHGFYATPDIGFDWKEGKGTPFLYFTYGAAFAEVEIDTLTGDFHTRTADIVMDLGFSINPAIDIGQIEGAFIQGLGWVAMEELKWGDNNHKWIRPGHLFTCGPGAYKIPSVNDIPLNFKVSLLKDAPNPKVIHSSKAVGEPPFFLGSAVLFAIKDAIFAARADEGHSEWFPLDNPATPERIRMACVDSITKKFADADYRPKLSV

SEQ ID NO: 6038 - protein, 461 aa, Saccharum officinarum
GNEIHMVSSTQAPQKHQKYVASILGLPQSKVVCKTKRIGGGFGGKESRSAIFAAAASVPSFCLRRPVKLVLDRDVDMISTGQRHSFLGKYKVGFTNEGKILALDLEIYNNGGHSLDLSLAVLERAMFHSENVYDIANIRINGQVCLTNFPSNTAFRGFGGTQGLLIAENWIHHIATELQRSPEEIKELNSHNDGVVLHYGQLLQNCTIGPVWDQLKASCNFVEARKAVNSFNSNNRWRKRGIAMIPTQFGISFTTKFMNQAGALVQVYTDGTVLVTHGGVEMGQGLHTKIAQVAASSFNIPLSSVFISETSTDKVPNASPTAASASSDLYGAAVLDACQQIKVRMEPIASKGTHNSFAELAQACYMERVDLSAHGFYATPNIGFDWTIGKGTPFNYFTYGAAFAEVEIDTLTGDFYTRTADIVMDLGFPINPAIDIGQIEGSFIQGLGWATMEELKWGMIT

SEQ ID NO: 6039 - protein, 594 aa, Panicum virgatum
QEHFYMEPQGTLVWPVDSGNEMHMVSSTQAPQKHQKYVANVLGLPLSKVVCKTKRIGGGFGGKETRSAVFAAAVSVPSYCLRRPVKLILDRDVDMISSGQRHSFLGRYKVGFTNDGKILALDLEIYNNGGNSLDLSLAVLERAMFHAENVYDISNIRVSGQVCFTNFPSNTAFRGFGGPQGMLIAENWIHHIASELQRSPEDIKELNFHNDGTMLHYGQLLQNCKIRSVWDELKASCKFMEARKAVRSFNSNNRWRKRGIAMVPTKFGISFTAKFMNQAGALVQVYTDGTVLVTHGGVEMGQGLHTKVAQVAASSFNIPLSSVFISETSTDKVPNASPTAASASSDLYGAAVLDACQQIKARMEPIASRGTHNSFAELAQTCYMERVDLSAHGFYATPDIGFDWDDGKGTPFLYFTYGAAFAEVEIDTLTGDFHTRTADIVMDLGFSINPAIDIGQIEGAFIQGLGWVALEELKWGDQNHKWIRPGHLFTCGPGAYKIPSVNDIPLNFKVSLLKGAPNPKVIHSSKAVGEPPFFLGSAVLFAIKDAIFAARADEGHKEWFPLDNPATPERIRMACVDSITKKFANADYRPKLSV

SEQ ID NO: 6040 - protein, 179 aa, Pennisetum glaucum
RESKKAMMYSDVGRLNCSVSYTTFATPVRGQGGDNKEYSSMLHKALEGAVMLHTFPKTTVDVFALVLESGGSDLPIIISCASLALADAGIMMYDLVTSVSVSCFGKNIIIDPTSDEEAWQDGSLMVAFMPARKEITQLTLTGEWSDGRITNAVELCMDACSKLGEILRDRLKEATLTSE

SEQ ID NO: 6041 - protein, 97 aa, Avena sativa
GIRGQGLDNKEYSGMLHKALEGAVMLHTFPKTTVDVFALVLESGGSDLPIIISCASLALADAGIMMYDLVTSVSVSVRKTLSSIQAQTRRHGKMEAL

SEQ ID NO: 6042 - protein, 126 aa, Triticum aestivum
SARGTVDVFALVLESGGSDLPIIISCASLALADAGIMMYDLVTSVSVSCFGKNIIIDPTSDEEAWQDGSLVVAFMPARKEITQLTLTGEWSDGRITNAVELCMDACSKLGDILRDHLKDTATLTSE

SEQ ID NO: 6043 - protein, 114 aa, Saccharum officinarum
QLFLSGDLPIIISCTSLALADAEIMMYDLVTSVSVSCFGKNIIIDPTSDEEAWQDGSLVVAFMPARKEVTQLTLTGEWSDGRITNAVELCMDACSKLGDILRDRLKDTATLISE

SEQ ID NO: 6044 - protein, 279 aa, Triticum aestivum
DFEMRSLIVDVENCLQAFVGVAHNLNAIIVAIRGTQENSVQNWIKDLVWKQLDLSYPDMPNAKVHSGFFSSYNNTILRLAITSAVHKARKTYGDIGVIVTGHSMGGAMAAFCALDLAIKLGSDNVQLMTFGQPRVGNAVFASYFAKYVPNTIRLVHGHDIVPHLPPYFSFLSKLTYHHFPREVWIDDSDDNTTEQICDASGEDPNCCRCLSILSLSIQDHFTYLGVDMESDDWSTCRIITAQSVERLRKDLASNIIMTKHGVEVSIVENSVQTDWSSSI

SEQ ID NO: 6045 - protein, 221 aa, Triticum aestivum
MPNAKVHSGFFSSYNNTILRLAITSAVHKARKTYGDIGVIVTGHSMGGAMAAFCALDLAIKLGSDNVQLMTFGQPRVGNAVFASYFAKYVPNTIRLVHGHDIVPHLPPYFSFLSKLTYHHFPREVWIDDSDDNTTEQICDASGEDPNCCRCLSILSLSIQDHFTYLGVDMESDDWSTCRIITAQSVERLRKDLASNIIMTKHGVEVSIVENSVQTDWSSSI

SEQ ID NO: 6046 - protein, 73 aa, Triticum aestivum
DFEMRSLIVDVENCLQAFVGVDHNLNAIIVAIRGTQENSVQNWIKDLVWKQLDLSYPDMPNAKVIANKLFILS

SEQ ID NO: 6047 - protein, 137 aa, Festuca arundinacea
  misc_feature (73)..(73): Xaa can be any naturally occurring amino acid
  misc_feature (109)..(109): Xaa can be any naturally occurring amino acid
  misc_feature (136)..(136): Xaa can be any naturally occurring amino acid
ARGEYVPNTIRLVHAHDIVPHLPPYFSFLSKLTYHHFPREVWINDSEDNTTEQICDSSGEDPNCCRCLSILSXSIQDHFTYLGVDMEADDWSTCRIIRAQSVEQLRKDXASNIIMAKHNVDVSIVENGVQTDWSSXR

SEQ ID NO: 6048 - protein, 216 aa, Setaria italica
MQRGFFSSYNNTILRLAITSAVHKARKSYGDINVIVTGHSMGGAMASFCALDLAMKLGSDSVQLMTFGQPRVGNAAFASCFAKYVPNTIRVTHGHDIVPHLPPYFSFLPQLTYHHFPREVWVQDSKGNTTEQICDNSGEDPDCCRSVSMFSLSIQDHFTYLGVDMQADDWSTCRIIAAQSVKQFRKELTSNIITTKHNADISIVEPSVQTDWSSSR

SEQ ID NO: 6049 - protein, 694 aa, Setaria italica
VTPSKRRAIYLSTAKTLAAIHKVDVNAIGLQKYGRRDNYCKRQVERWEKQYLASTGEGKPARYQRMLNLARWLKEHVPQEDSSAGSGTGLVHGDYRADNLVFHPTEDRVIGVIDWELSTLGNQMCDVAYSCLPYIIDATPGERTSYGGFQHAGIPDGVPQLEEYLSVYCSFSARTWPAANWKFYVAFSLFRGASIYAGVYHRWTMGNASGGERAKFAGRIANTMVDCAWDFINRKNVLQEQPSRGFQVSEAPWQEFGREQEGSTSTKDQGKFVPSEKVMQLRKKLMKFIEDHIYPMEGEFYKHAQSTSRWTIHPEEENLKALAKKEGLWNMFIPLDSAARARKLLFEDRSLVSPGSSNDLLLGAGLTNLEYGYLCEIMGRSVWAPQIFNCGAPDTGNMEVLLRYGTKEQQKQWLVPLLEGKIRSGFAMTEPQVASSDATNIECSISRQGDFYVINGRKWWTSGAMDPRCKILILMGKTDFSAPKHKQQSMILVDIDTPGVHVKRPLLVFGFDDAPHGHAEITFENVRVPVKNILLGEGRGFEIAQGRLGPGRLHHCMRLIGAAERGMDLMVERALNRTAFGKRIAQHGSFLSDLAKCRVDLEQARLLVLEAADQLDRHGNKKARGILAMAKVAAPNMALKVLDMAMQVHGAAGLSSDTVLSHLWATARTLRIADGPDEVHLGTIAKLELQRARL

SEQ ID NO: 6050 - protein, 545 aa, Avena sativa
MRPVISDGIPQLEEYLSVYCSMSARPWPATNWKFYIAFSLFRGASIYAGVYHRWTMGNASGGERAKFAGKAGNVMVDCAWDYINRENVLPERPATVTDFSRAPRQELHSEQEGSTLTNGQGRFVPSEKVMLLREKIMKFMKDHIYPKEDELYKHAQSASRWTIHPEEENLKALAKQQGLWNLFIPLDSAARARELLLEDRSHISPGSSDDLLLGAGLTNLEYGYLCEIMGRSVWAPQIFNCGAPDTGNMEVLLRYGTKEQQKQWLVPLLEGKIRSGFAMTEPQVASSDATNIECAISRQGDFYVINGKKWWTSGAMDPRCKILILMGKTDFSAPKHKQQSMILVDINTPGVQIRRPLLVFGFDDAPHGHAEITFDNVRVPATNILLGEGRGFEIAQGRLGPGRLHHCMRLIGAAERGMNMMVERALSRTVFGKRIAQHGSFQSDLAKCRIELEQTRLLVLEAADQLDRHGNKKARGILAMAKVAAPNMALKVLDMAMQVHGAAGVSSDTALSHLWATARTLRIADGPDEVHLGTIAKLELQRARL

SEQ ID NO: 6051 - protein, 405 aa, Setaria italica
MAKLTSELLRPVDPAHALDEAALLRFAAANVPGFPGPAPALALTQFGHGQSNPTYCIQASAPGGGRTTRYVLRKKPPGAILQSAHAVEREYQVLKALGAHTDVPVPKVYCLCTDASVIGTPFYIMEYLEGIISDNALPGVTPSKRRAIYLSTAKTLAAIHKVDVNAIGLQKYGRRDNYCKRQVERWEKQYLASTGEGKPARYQRMLNLARWLKEHVPQEDSSAGSVVHGDYRADNLVFHPTEDRVIGVIDWELSTLGNQMCDVAYSCLPYIIDATPGERTSYGGFQHAGIPDGVPQLEEYLSVYCSFSARTWPAANWKFYVAFSLFRGASIYAGVYHRWTMGNASGGERAKFAGRIANTMVDCAWDFINRKNVLQEQPSRGFQVSEAPWQEFGREQEGSTWQICS

SEQ ID NO: 6052 - protein, 268 aa, Pseudoroegneria spicata
DAEKPQAAATPEQSKRPVVSYWGIEPRKLVKDDGTEWPWFCFRPWDTYRPDTSIDVAKHHEPRALADKVAYFVVRSLRVPRDLFFQRRHASHALLLETVAAVPPMVGGVLLHLRSLRRFEHSGGWIRALMEEAENERMHLMTFMEVTQPRWWERALVLAAQGVFFNAYFVGYLISPKFAHRFVGYLEEEAVESYTEYLKDLEAGLIENTPAPAIAIDYWRLPADARLKDVVTAVRADEAHHRDANHYASDIHYQGMTLNQTPAPLGYH

SEQ ID NO: 6053 - protein, 332 aa, Sorghum bicolor
MSSRMAGAAVLRHLGPRLFAAEQAAVSGLTARGVMPAAARLLPARMASTAAEAAREDAGAKQHGGTGKQEEAAGGGQSKKAIVSYWGIEAPKLVKEDGTEWKWTSFRPWDAYTSDTSIDVKKHHAPTTLPDKAAYLIVKSLRVPMDLFFQRRHASHALLLETVAAVPGMVGGMLLHLRSLRRFEHSGGWIRALLEEAENERMHLMTFLEVTQPKWWERALVLATQGVFFNAYFVGYLLSPKFAHRVVGYLEEEAVYSYTEYLKDLEAGIIENTPAPAIAIDYWRLPADAKLKDVVTVVRADEAHHRDVNHFASDIHYQGMKLRDTPAPLGYH

SEQ ID NO: 6054 - protein, 290 aa, Pennisetum glaucum
MASTAAAKEDAGAKHHGSSGGGGGAEKQEEPAGGQSKKAIVSYWGIDTPKLVKADGTEWTWACFRPWDTYTSDTSIDVKKHHEPTTLPDKAAYLMVKSLRMPMDLFFQRRHASHALLLETVAAVPGMVGGMLLHLRSLRRFEQSGGWIRALLEEAENERMHLMTFLEVAQPRWWERALVLAAQGVYFNAYFVAYLASPKFAHRFVGYLEEEAVHSYTEYLKDLEAGLIENTPAPAIAIDYWRLPADARLKDVVTVVRADEAHHRDVNHFASDIHYQGMKLKDTPAPLGYH

SEQ ID NO: 6055 - protein, 286 aa, Saccharum officinarum
MASTAAEAAREDAGAKQHGGTGKREEAANGQSKKAIVSYWGIEPPKLVKEDGTEWKWPCFRPWDAYTSDTSIDVKKHHAPTTLPDKAAYLIVKSLRVPMDLFFQRRHASHALLLETVAAVPGMVGGMLLHLRSLRRFEHSGGWVRALLEEAENERMHLMTFLEVTQPRWWERALVLATQGVFFNAYFVGYLLSPKFAHRVVGYLEEEAVHSYTEYLKDLEAGIIENSPAPAIAIDYWRLPADAKLKDVVTVVRADEAHHRDVNHFASDIHYQGMKLRDTPAPLGYH

SEQ ID NO: 6056 - protein, 334 aa, Panicum virgatum
MSSRMAGAALLRHLGPRLFAAEPAVSELAARGGMPAAARILPARMASTAAEAAREDAGAKQHGSSGGGTEKQEEAAGGQSKKAIVSYWGIEPPKLVKADGTEWRWPCFRPWDSYTSDTSIDVKKHHEPTTLPDKAAYLLVKSLRVPMDLFFQRRHASHALLLETVAAVPGMVGGMLLHLRSLRRFEHSGGWIRALLEEAENERMHLMTFLEVTQPRWWERALVLAAQGTFFNAYFVGYLLSPKFAHRVVGYLEEEAVHSYTEYLKDLEAGVIENTPAPAIAIDYWGLPADARLKDVVTVVRADEAHHRDVNHFASDIHYQGMKLKDTPAPLGYH

SEQ ID NO: 6057 - protein, 314 aa, Sorghum bicolor
MSSRMAGAAVLRHLGPRLFAAEPLTVPAAARILPARMSSTAAAPEQRQKPEAPAPEGQDKIKAVVSYWGIQPRKLVKEDGTEWRWFCFRPWDTYRADTSIDMKKHHEPKALPDKLAYWLVKSLIVPKQLFFQRRHASHALLLETVAAVPGMVGGMLLHLGSLRRFEHSGGWIRALLEEAENERMHLMTFLEVAQPKWWERALVLAAQGVFFNAYFVAYLASPKFAHRFVGYLEEEAVHSYTEYLKDLEAGVIENTPAPAIAIDYWRLPADAKLKDVVTVVRADEAHHRDVNHFASDIHYQGMKLKDTPAPLGYH

SEQ ID NO: 6058 - protein, 332 aa, Zea mays
MSSRMAGAALLRHLGPRLFAAGPAVSGLTARGGMPAAARLLPARMASTAAEAAREDAGANKRHGGTEKHEEEAAGGQSKKAVVSYWGIDTPKLVKEDGTEWKWTSFRPWDAYTSDTSIDIGKHHAPTTLPDKAAYLIVKSLRVPMDLFFQRRHASHALLLETVAAVPGMVGGMLLHLRSLRRFEHSGGWIRALLEEAENERMHLMTFLEVTQPRWWERALVLTAQGVFFNAYFVGYLLSPKFAHRVVGYLEEEAVHSYTEYLKDLEAGIIDNTPAPAIAIDYWRLPADAKLKDVVTVVRADEAHHRDVNHFASDIHYQGMKLKDTPAPLSYH

SEQ ID NO: 6059 - protein, 329 aa, Zea mays
MSSRMAGAALLRHLGPRLFAAEPVTGLAARGVMPAAARILPARMSSTAAEAAKEAAAPQQRQKPEAAAAAPEGQDKKAVVSYWGIEPRKLVKEDGTEWRWFCFRPWDTYRADTSIDMKKHHEPKALPDKLAYWLVKSLVVPKQLFFQRRHASHALLLETVAAVPGMVGGMLLHLRSLRRFEHSGGWIRALLEEAENERMHLMTFLEVAQPKWWERALVLAAQGVYFNAYFVAYLASPKFAHRFVGYLEEEAVHSYTEYLKDLEAGIIDNTPAPAIAIDYWRLPADARLKDVVAVVRADEAHHRDVNHFASDIHYQGMKLRDTPAPLGYH

SEQ ID NO: 6060 - protein, 335 aa, Oryza sativa
MSSRMAGATLLRHLGPRLFAAEPVYSGLAASARGVMPAAARIFPARMASTSSAGADVKEGAAEKLPEPAATAAAAATDPQNKKAVVSYWGIQPPKLVKEDGTEWKWLSFRPWDTYTSDTSIDVTKHHEPKGLPDKLAYWTVRSLAVPRDLFFQRRHASHALLLETVAGVPGMVGGMLLHLRSLRRFEQSGGWIRALLEEAENERMHLMTFLEVMQPRWWERALVLAAQGVFFNAYFVGYLVSPKFAHRFVGYLEEEAVSSYTEYLKDLEAGKIENTPAPAIAIDYWRLPADATLKDVVTVIRADEAHHRDLNHFASDIQQQGMKLKDTPAPIGYH

SEQ ID NO: 6061 - protein, 285 aa, Saccharum officinarum
MSSTAVEAAKEAAAPEEQRQKLEAPAPEGQDKKAVVSYWGIQPRKLVKEDGTEWRWFCFRPWDTYRADTSIDMKKHHEPKALLDKLAYWLVKSLVVPKQLFFQRRHASHALLLETVAAVPGMVGGMLLHLRSLRRFEHSDGWIRALLEEAENERMHLMTFLEVAQPKWWERALVLAAQGVYFNAYFVAYLASPKFAHRFVGYLEEEAVHSYTEYLKDLEAGIIDNTPVPAIAIDYWRLPADAKLKDVVTIVRADEAHHRDVNHFASDIHYQGMKLKDTPAPLGYH

SEQ ID NO: 6062 - protein, 340 aa, Curcuma longa
MGSRMAGSALFRHLGPRLFSAASASRSSAALEPSFSLLQSSSLSPSPVLLRLFPVRMASTSASPALGGEAHKEDEAKSAAAVHPSEGKHVSSYWGIERYKITKEDGTPWRWSCFTPWEAYKSDTSIDLNKHHVPTTFLDKIAYWTVKVLRFPTDIFFQRRYGCRAMMLETVAAVPGMVGGMFLHLRSLRRFEHSGGWIRALLEEAENERMHLMTFMEVAQPRWYERALVLAVQGVFFNAYFLGYLVSPKFAHRVVGYLEEEAIHSYTEYLKDLEAGKIENVPAPAIAIDYWCLPPDATLKDVVTVVRADEAHHRDVNHFASDIHYQGMELKNTPAPLGYH

SEQ ID NO: 6063 - protein, 222 aa, Zingiber officinale
  misc_feature (70)..(70): Xaa can be any naturally occurring amino acid
GVQSDTSIDLNKHHVPTTFLDKIAYWTVKILRFPTDIFFQRRYGCRAMMLETVAAVPGMVGGMFLHLRSXRRFEHSGGWIRALLEEAENERMHLMTFMEVAQPRWYERALVLAVQGVFFNAYFLGYLVSPKFAHRVVGYLEEEAIHSYTEYLKDLEAGKIENVPAPAIAIDYWCLPPDATLKDVVTVVRADEAHHRDVNHFASDIHYQGMELKSTPAPLGYH

SEQ ID NO: 6064 - protein, 194 aa, Setaria italica
KSLRFPTGVFFQRRYGCRAMMLETVAAVPGMVGGMLLHLRSLRRFEHSGGWIRALMEEAENERMHLMTFMEVAKPRWYERALVLAVQGVFFNAYFLGYLVSPKFAHRVVGYLEEEAIHSYTEYLKDLEAGKIDNVPAPAIAIDYWRLPANATLKDVVTVVRADEAHHRDVNHFASDIHCQGMQLKESPAPIGYH

SEQ ID NO: 6065 - protein, 336 aa, Avena sativa
MRSRVAGSVLLRNLSPRVFGPATPAAASRPLLVGGEGGVWARLLATSAAEAAKEEVAASKDNVASTAAAKAEAVQAAKEGEKGAVVSSYWGIVPAKLVNKDGAEWKWSCFRPWEAYTSDTSIDLTKHHQPKILLDKIAYWTVKSLRVPTDIFFQRRYGCRAMMLETVAAVPGMVGGMLLHLRSLRRFEHSGGWIRALLEEAENERMHLMTFMEVADPKWYERALVLAVQGVFFNAYFVGYLLSPKFAHRVVGYLEEEAIHSYTEFLRDLEAGKIENVPAPRIAIDYWRLPADATLKDVVTVVRADEAHHRDVNHFAADIHFQGLELNKTPAPLGYH

SEQ ID NO: 6066 - protein, 210 aa, Triticum aestivum
HHKPKVLLDKIAYWTVKSLRVPTDIFFQRRYGCRAMMLETVAAVPGMVGGMLLHLRSLRRFEQSGGWIRALLEEAENERMHLMTFMEVAKPKWYERALVLAVQGVFFNAYFLGYIVSPKFAHRVVGYLEEEAIHSYTEFLRDLEAGRIENVPAPRIAIDYWRLPADARLKDVVTVVRADEAHHRDVNHFAADIHFQGLELNKTPAPLGYH

SEQ ID NO: 6067 - protein, 317 aa, Saccharum officinarum
SPRPPLALAGCGERGGVAVWVRLLSTSAAEAKEEAAASKGNAGSTAAAKAEAAEAAKEGDGKRDKVVSSYWGVAPSKLMSKDGVEWRWSCFRPWEAYKPDTSIDLTRHHEPKVLLDKIAYWTVKLLRVPTDIFFQRRYGCRAMMLETVAAVPGMVGGMLLHLRSLRRFEPSGGWIRALLEEAENERMHLMTFMEVAKPKWYERALVLAVQGVFFNAYFLGYLISPKFAHRVVGYLEEEAIHSYTEYLKDLEAGKIENVPAPAIAIDYWQLPADATLKDVVIVVRSDEAHHRDVNHFASDIHFQGMQLKETPAPLGYH

SEQ ID NO: 6068 - protein, 363 aa, Setaria italica
MSSRAAGSVLLRHLGPRVFGPVSSPVAAAPRPLLAQAAAAVWVRLLSTSAAEVKEEAAASKGNASSTAAAKAEAAEAAREGDGKKSPVVSSYWGIEPSKLVSKDGVEWRWSCFHRLPFRDRAPFADLGLNWRDPSPCANPAAVGVVQTGHLDRSHQAPQAQGAARQDRLLDRQIPALSHRHILPEEVRLPRDDAGDGGGGAGDGGRHAAAPALAPPLRAQRRLDPGADGGGRERAHAPHDLHGGGQAQVVRARARPRRAGGLLQRLFSRLPRLPQVRAPRRRLPRGGGHPLLHRVPQGHRGRQDPAPAIAIDYWQLPADARLKDVVTVVRADEAHHRDVNHFASDVHFQGMELKEVPAPLGYH

SEQ ID NO: 6069 - protein, 347 aa, Zea mays
MSTRAAGSALLRHLGPRVFGPVFSPAVAPPRPLLALAGGGERGGALVWVRVRLLSTSAAEAKEEVAASKGNSGSTAAAKAEAVEAAKEGDGKRDKVVSSYWGVAPSKLMNKDGAEWRWSCFRPWEAYKPDTTIDLNRHHEPKVLLDKIAYWTVKLLRVPTDIFFQRRYGCRAMMLETVAAVPGMVGGMLLHLRSLRRFEHSGGWIRALLEEAENERMHLMTFMEVAKPKWYERALVLAVQGVFFNAYFLGYLISPKFAHRVVGYLEEEAIHSYTEYLKDLEAGKIENVPAPAIAIDYWQLPADATLKDVVVVVRSDEAHHRDVNHFASDIHFQGMQLKETPAPIEYH

SEQ ID NO: 6070 - protein, 328 aa, Zea mays
MSSRAGSILLRHAGSRLFTAAAISPAAASRPLLAGGNGVPAVMLRLMSTSSPAAPTEAKDEAAKASKVGGDKKAVVINSYWGIEQNNKLARDDGTEWKWTCFRPWETYTADTSIDLTRHHEPKTLMDKVAYWTVKSLRFPTDIFFQRRYGCRAMMLETVAAVPGMVGGMLLHLRSLRRFEQSGGWIRALLEEAENERMHLMTFMEVAKPRWYERALVITVQGVFFNAYFLGYLLSPKFAHRVVGYLEEEAIHSYTEYLKDLEAGKIENVPAPAIAIDYWRLPANATLKDVVTVVRADEAHHRDVNHFASDIHCQGMQLKQSPAPIGYH

SEQ ID NO: 6071 - protein, 346 aa, Sorghum bicolor
MSTRAAGSVLLRHLGPRVFGSVSSSPAAAPPRPLLALAGGGEWRGAAVWVRLLSTSAAEAKEEAAASKGNAGSTAAAKAEAVEAAKEGDGKKDKVVSSYWGVAPSKLMSKDGVEWRWSCFRPWEAYKPDTSIDLTRHHEPKVLLDKIAYWTVKLLRVPTDIFFQRRYGCRAMMLETVAAVPGMVGGMLLHLRSLRRFEHSGGWIRALLEEAENERMHLMTFMEVAKPKWYERALVLAVQGVFFNAYFLGYLISPKFAHRVVGYLEEEAIHSYTEYLKDLEAGKIENVPAPAIAIDYWQLPADATLKDVVVVVRSDEAHHRDVNHFASDIHFQGMQLKETPAPIEYH

SEQ ID NO: 6072 - protein, 332 aa, Oryza sativa
MSSRMAGSAILRHVGGVRLFTASATSPAAAAAAAARPFLAGGEAVPGVWGLRLMSTSSVASTEAAAKAEAKKADAEKEVVVNSYWGIEQSKKLVREDGTEWKWSCFRPWETYTADTSIDLTKHHVPKTLLDKIAYWTVKSLRFPTDIFFQRRYGCRAMMLETVAAVPGMVGGMLLHLRSLRRFEQSGGWIRTLLEEAENERMHLMTFMEVANPKWYERALVITVQGVFFNAYFLGYLLSPKFAHRVVGYLEEEAIHSYTEFLKDLEAGKIDNVPAPAIAIDYWRLPANATLKDVVTVVRADEAHHRDVNHFASDIHYQGMELKQTPAPIGYH

SEQ ID NO: 6073 - protein, 330 aa, Sorghum bicolor
MSSRAGSILLRHAGSRLFTAAAVSPAAASRPLLAGGSNNGVQAVMLRLMSTSSPAAASEAKDEAAKASKEGGDKKAVVINSYWGIEQNNKLVRDDGTEWKWTCFRPWETYTADTSIDLTRHHEPKTLMDKIAYWTVKSLRFPTDIFFQRRYGCRAMMLETVAAVPGMVGGMLLHLRSLRRFEQSGGWIRALLEEAENERMHLMTFMEVAKPRWYERALVITVQGVFFNAYFLGYLLSPKFAHRVVGYLEEEAIHSYTEYLKDLEAGKIENVPAPSIAIDYWRLPANATLKDVVTVVRADEAHHRDVNHFASDIHCQGMQLKQSPAPIGYH

SEQ ID NO: 6074 - protein, 330 aa, Saccharum officinarum
MSSRAGSVLLRRAGSRLFTAAAVSPAAASRPLLAGGNNVVQAVMVRLMSTSSPAAVSEATKDEAAKASKEGGDKKAVVINSYWGIEQNNKLVRDDGTEWKWTCFRPWETYTADTSIDLTRHHELKTLMDKIAYWTVKSLRFPTDIFFQRRYGCRAMMLETVAAVPGMVGGMLLHLRSLRRFEQSGGWIRALLEEAENERMHLMTFMEVAKPRWYERALVITVQGVFFNAYFLGYLLSPKFAHRVVGYLEEEAIHSYTEYLKDVEAGKIENVPAPAIAIDYWRLPANATLKDVVTVVRADEAHHRDVNHFASDIHCQGMQLKQSPAPIGYH

SEQ ID NO: 6075 - protein, 347 aa, Triticum aestivum
MSSRVAGSVLLRHLGPRVFGPTTPAAQRPLLAGGEGGAVAVAMWARPLSTSAAEAAREEATASKDNVASTAAATAEAMQAAKADAVQAAKEGKSPAASSYWGIVPAKLVNKDGAEWKWSCFRPWEAYTSDTTIDLSKHHKPKVLLDKIAYWTVKSLRVPTDIFFQRRYGCRAMMLETVAAVPGMVGGMLLHLRSLRRFEQSGGWIRALLEEAENERMHLMTFMEVANPKWYERALVLAVQGVFFNAYFLGYIVSPKFAHRVVGYLEEEAIHSYTEFLRDLEDGRIENVPAPRIAIDYWRLPPDARLKDVVTVVRADEAHHRDVNHFAADIHFQGLELNKTPAPLGYH

SEQ ID NO: 6076 - protein, 347 aa, Triticum aestivum
MSSRVAGSVLLRHLGPRVFGPTTPAAQRPLLAGGEGGAVAVAMWARPLSTSAAEAAREEATASKDNVASTAAATAEAMQAAKAGAVQAAKEGKSPAASSYWGIVPAKLVNKDGAEWKWSCFRPWEAYTSDTTIDLSKHHKPKVLLDKIAYWTVKSLRVPTDIFFQRRYGCRAMMLETVAAVPGMVGGMLLHLRSLRRFEQSGGWIRALLEEAENERMHLMTFMEVANPKWYERALVLAVQGVFFNAYFLGYIVSPKFAHRVVGYLEEEAIHSYTEFLRDLEDGRIENVPAPRIAIDYWRLPPDARLKDVVTVVRADEAHHRDVNHFAADIHFQGLELNKTPAPLGYH

SEQ ID NO: 6077 - protein, 333 aa, Brachypodium distachyon
MSSRMAGSVLLRHAGASRLFSATATSPAAAAARPFLAGGESVPGAWVRLMSTSAGSQAKQEAAKAAAPPKDKEGGEKKEVVVNSYWGIEQAKKLVREDGTEWKWSCFRPWETYTADTSIDLTKHHVPKTMLDKIAYWTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLEAGKIDDVPAPSIAIDYWRLPANATLKDVVTVVRADEAHHRDVNHFASDVYYQGMELKATPAPIGYH

SEQ ID NO: 6078 - protein, 343 aa, Brachypodium distachyon
MSSRVAGPAVLLRHLGRRIFSSPVSPASPVAAQRPLLSGGEGAVWARLRLLSTSAAEEAAKEEAAASKENSASTAAAKAEAAQAAKDGDKTVVSSYWGIVPAKLVNKDGAEWKWSCFRPWEAYTSDTTIDLKKHHEPKVLLDKIAYWTVKSLRVPTDIFFQRRYGCRAMMLETVAAVPGMVGGMLLHLRSLRRFEHSGGWIRALLEEAENERMHLMTFMEVAGPKWYERALVLAVQGVFFNAYFLGYLLSPKFAHRVVGYLEEEAVHSYTEFLRDIEAGKIDNVPAPRIAIDYWRLPPDATLRDVVVVVRADEAHHRDVNHFASDIHFQGLELNKTPAPLGYH

SEQ ID NO: 6079 - protein, 294 aa, Leymus cinereus x Leymus triticoides
MLSWVRMMSTSAASQAKDEAAKAAKSVKAEAAKGDGEKKEVVVNSYWGIEQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFLGYLISPKFAHRVVGYLEEEAVHSYTEFLKDLEDGKIDNVPAPAIAIDYWRLPANATLRDVVTVVRADEAHHRDVNHFASDVYYQGMQLKATPAPIGYH

SEQ ID NO: 6080 - protein, 194 aa, Elaeis guineensis
GRLTSGYYCHLQRRYGCRAMMLETVAAVPGMVGGMLLHLRSLRRFEQSGGWIRALLEEAENERMHLMTFMEVAKPRWYERALVIAVQGIFFNAYFVGYLLSPKFAHRVVGYLEEEAIHSYTEYLKDLDAGKIPNVPAPAIAIDYWRLLPDATLKDVVTVVRADEAHHRDVNHFASDVHYQGMELKEAPAPLGYH

SEQ ID NO: 6081 - protein, 269 aa, Panicum virgatum
  misc_feature (200)..(200): Xaa can be any naturally occurring amino acid
  misc_feature (210)..(210): Xaa can be any naturally occurring amino acid
  misc_feature (252)..(252): Xaa can be any naturally occurring amino acid
KAEAVEAAKEGGGEKSPAVNSYWGIEPSKLVSKDGVEWRWSCFRPWETYKPNTSIDLTRHHEPKVLLDKLAYWTVKSLRAPTDIFFQRRYGCRAMMLETVAAVPGMVGGMLLHLRSLRRFEHSGGWIRVLLEEAENERMHLMTFMEVAKPRWYERALVLAVQGVFFNAYFLGYLISPKFAHRVVGYLEEEAIHSYTEYLXDIEDGKIENXPAPAIAIDYWQLPADATLKDVVTMVRADEAHHRDVNHFASDXHFQGMELKETPAPLEYH

SEQ ID NO: 6082 - protein, 327 aa, Panicum virgatum
MSSRMAGSILLRHTGTRVFAAAATRPALLAGADGVPAVMGRFMSTSSSPAAAAATPPQKAKEEAAKDGGDKKAVVINSYWGIEQTNKLMREDGTEWKWTCFRPWETYTADTSIDLTRHHEPKTMLDKIAYWTVKSLRFPTDVFFQRRYGCRAMMLETVAAVPGMVGGMLLHLRSLRRFEQSGGWIRALLEEAENERMHLMTFMEVAKPRWYERALVIAVQGVFFNAYFLGYLLSPKFAHRVVGYLEEEAIHSYTEYLKDLEVGKIDNVPAPAIAIDYWRLPANATLKDVVTVVRADEAHHRDVNHFASDIHCQGMQLKESPAPIGYH

SEQ ID NO: 6083 - protein, 328 aa, Triticum aestivum
MSSRMAGSVLLRRAGAGAGRLFATTASPAARTALGGGEGAWVRMMSTSAASQVKDEAAKGVKAEAAKGDGEKKEVAISSYWGIEQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 6084 - protein, 285 aa, Triticum aestivum
MMSTSAASQVKDEAAKAVKAEAAKGDGEKKEVAISSYWGIEQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 6085 - protein, 341 aa, Hordeum vulgare
MSSRMAGSVLLRHAGAGADRLFATTASPAARTALAGGEGAWARMMSTSAASHAKDEAAKAAATGDGEKKEVAVNSYWGIEQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVITVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMELKATPAPIGYHWLGRLLLNFASLLLPSK

SEQ ID NO: 6086 - protein, 324 aa, Hordeum vulgare
MSSRMAGSVLLRHAGAGAGRLFATTASPAARTALAGGEGAWARMMSTSAASHAKDEAAKAAATGDGEKKEVAVNSYWGIEQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVITVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMELKATPAPIGYH

SEQ ID NO: 6087 - protein, 345 aa, Oryza sativa
MGSRAAGSVLLRHLCPRVSSSTSAAAHAHAQRPPLAGAGGGGVALWARLLSTSAAAAKEETAASKENTGSTAAAKAEATKAAKEGPASATASPVASSYWGIEASKLASKDGVEWKWSCFRPWETYSPDTTIDLKKHHEPKVLLDKVAYWTVKALRVPTDIFFQRRYGCRAMMLETVAAVPGMVGGMLLHLRSLRRFEHSGGWIRALLEEAENERMHLMTFMEVAKPRWYERALVLAVQGVFFNAYFLGYLLSPKLAHRVVGYLEEEAIHSYTEYLKDIEAGKIENVPAPPIAIDYWRLPAGATLKDVVVVVRADEAHHRDVNHFASDVHFQGMDLKDIPAPLDYH

SEQ ID NO: 6088 - protein, 175 aa, Festuca arundinacea
GTRETVAAVPGMVGGMLLHLRSLRRFEQSGGWIRALLEEAENERMHLMTFMEVADPKWYERALVLAVQGVFFNAYFVGYLLSPKFAHRVVGYLEEEAIHSYTEFLRDLEAGKIENVPAPRIAIDYWRLPADARLKDVVTVVRADEAHHRDVNHFAADIHFQGLELNKTPAPLGYH

SEQ ID NO: 6089 - protein, 187 aa, Triticum aestivum
AEGDLGITADDDKGDDEKPTMEESSSLQRQAELSCVICWTDFSSSRGILPCGHRFCYSCIQGWADCLSSRGKVSTCPLCKASFSWISKVDEAGTSDQKIYSQTPVPCGASTSIFMFTDEGHGDFPGSSSSAAQGACYMCHSREPEELILSCHVCRSQWVHSYCLDPPLTPWTCIHCRDLRRMYQRYR

SEQ ID NO: 6090 - protein, 585 aa, Brachypodium distachyon
MPVEGMDKVVATVSGYHADERHRLVKLISETGASYVGAMSRSITHLVCWRLEGKKYDIAKKLGTRVVSHRWFQDCLKEGRRLPEGPYMMESGEEAGPVQEPPTLPGKRSKRNAFMEDTCLEELPTDCCNTSYAKDVLNIGDSDSDFELQGLLDSSLLKEYAYPVNLLTELGFPVGFRILSLVGMLRRLIHEMSNKKGSVQSVHGNQQIKIFYIRETMPQVSCPESRLLKDLLTTKTGNNVYMYEAFCYYYDLNFLSYPCPSHTSSRGMSRQKGNLSALLHNEISGRMGERNDLMRKESQSKHARYLTEISDDDGSTDSFEEVQILDIPTTEARTKIGRRNASASFRQSTLDSIYSFGENSSHVYESEESEEQVNVEIGQSSRSLQPGDLFGDEPPFCTQEKIDQSNLDIVADHEKTDEEKPTMEESSNLQRQAELSCVICWTDFSSTRGILPCGHRFCYSCIQGWADCLSSRGKVSTCPLCKASFSWISKVDEAGTSDQKIYSQTIPCGASTDVFVFADDGYDLPGSSSAQGACYQCHSREPEELLLSCHVCRSRWVHSYCLDPPLTPWTCIHCRDLRRTYQRYR

SEQ ID NO: 6091 - protein, 531 aa, Oryza sativa
MPAVEGMRDVVATVSGYHGDERHRLVRLIAETGASYVGAMSRSITHLVCWRLEGKKYDIARRLRTRVVSHRWFEDCLKEGRRLPEKPYMLESGEEAGPVPELPTFPRSRSKRNASMEDRCLKELPDDFCNTSYATDVLVVADSGSDCNHQRWSDSSLLKENFVGDRDNSKIGATHVKERRKRLKHAQNSTNEDALDAEDNISRLMARQGRYESSYTSSRSASNQKGDLLKLLHNDDASMMRKRNSLMKKETRTKLAGYLIESCENGSLTDSFDEPQMSDTPPTEDRRKIRKTRLRQSTLDSIYDYGEASEHDPEKSEDQENFELGESSRSFQSSDSSRQEPAFCTEKTNQGSIDIAADDDKGDDEKATLEEPTSCQGQAELSCVICWTDFSSTRGILPCGHRFCYSCIQEWADSLSSRGKVSTCPLCKTSFAWISKIDEAGTSDQKIYSQTIPCSTSTDTFIFDDRVYGLPESPSGQGACYQCHCREPEELLLSCHVCRSQWVHSYCLDPPLTPWTCIHCRDLRMLYQRYR

SEQ ID NO: 6092 - protein, 647 aa, Triticum aestivum
FGHLSCSSSDVEIYLHMLSGDEITELLDTISRSFDASSVSVKALGLTITTFKVQELLGTLLSKSTTDLQRIAKGMVETFYKNLPLSRDLDPQESMHGEELLSMASNILVQLFWRTRNLGYLLEAVLVLEFGLTVRKHVWQYKITLVHLYSYLGALPLAHRWYVSLEVKNILLESVSHHILPQMLSSPFLQQTASLVKDYLRFMDDHLKESADLTCLAYRHRTYSKVIEFVQFKNRLQRSMQYLAVKSDSVILSLKQKSESLDEVESVLENVNHGGGLVDLSSEDNMKHLTFNEDLEARPWWTPTTSVNFLSEPIDESSTPACFRAKVCKHKSTEKDGPKMRDAERKCLVPRLVYLSMHGCVSSLRETEPNGSVSDITVGEMKTLLEKYARTIGYSMDDALSMILGISSGKKSMKDFAPDIVSWMSFAVFINAMNLWSNESVIPRTDPSSPSSWEIVDSLVKICIEEHLTDANRILTCPGNKIPLLVQMVTEPISWHLIIIQSCMRVVAPQGKKKKKSGPSVRPNMPQLQGIQRSVQCLIETLRSVQKWLSDQMSPEEQGLDILMSYLQGTGDEGPGQTFRVLEEKPIAHASELGDRIAQSLEAWSSTGVVRRIVGAEHEVLAEFKKMVDSKLKLLMSESASLSSMLH

SEQ ID NO: 6093 - protein, 439 aa, Pseudoroegneria spicata
  misc_feature (154)..(154): Xaa can be any naturally occurring amino acid
LKESADLTCLAYRHRTYSKVIEFVQFKNRLQRSMQYLAVKSDSVILSLKQKSESLEEVESVLENVNHGGGLVDLSSEDNMKHLTFNEDLEARPWWTPTTSVNFLSEPIDGSSTPACFRAKVCKHKSTEKDGPKMRDAERKCLVPRLVYLSMHGXVSSLRETEPNGSVSDITVGEMKTLLEKYARTIGYSMDDALSMILGISSGKKSMKDFAPDIVSWMSFAVFINAMNLWSNESVIPRTDPSSPSSWEIVDSLVKICIEEHLTDANRILTCPGNKIPLLVQMVTEPISWHLIIIQSCMRVVAPQGKKKKKSGPSLRPNMPQLQGIQRSVQCLIETLRSVQKWLSDQMSPEEQGLDILMSYLQGTEGPGQTFRVLEEKPAAHASELGDRIAQSLEAWSSTGVVRRIVGAEHEVLAEFKKMVDSKLKLLMSESASLSSVLH

SEQ ID NO: 6094 - protein, 200 aa, Triticum aestivum
FLRYNKTVVEKVPSLKGGGAYWFTDLTTPDELYILPVLTSVTFLATVELNMQEGMEGNPMLQTMKKFSRILALMTIPFTMHFPKAIFCYWVTANLFSLGYGFALRKTAVRYFLNLPEVVPQPEAAQVSTFNLFEAPKPVSAVDTPTGNNGDSPTGDNGDSPTAANGSEQSNAELSDRVVFLEKKIAELERRAKARGESQE

SEQ ID NO: 6095 - protein, 212 aa, Triticum aestivum
IADAALLLIEMAGNNNVKEKLRKLPLLSLRRSPKDCTLLESRILPNGQESVESATQKLEAFKLQLRKTDNASLAENGTEGTLNTSMPEKRNRWSIAKSWTPCPLGMIPCSYSSTAVLPVLDVIDDELKHDTAEHENFEPDGQIEIFDCYSQPEQQLDGEGILEISRLPPEHGISDMPESTFGLRGTLLVGGVWKKVTEEELLSIKSSMKILL

SEQ ID NO: 6096 - protein, 217 aa, Brachypodium distachyon
IADAALLLIEMAGNNNVKEKLRKLPLLSLRRSPKDCTLLESRILSNGQESVESATQKLEAFKLQLRKTDNVNLAENGTQGTLNTSMPEKRNRWSIAKSWTPCPLGMIPCSYSSTAVLPVLDVIDDELKHDTAEHENFEPDGQIEIFDCYSQPEQHLDGEGILEISRLPPEHGISDMPELTFGLRGTLLVDGLWKKVTEEELLSMKSNMTILLYYWLV

SEQ ID NO: 6097 - protein, 184 aa, Triticum aestivum
DIDVRMLGSGRPFLIEVLNVRSIPSAIEIQQISDKINSSEKKHVRIRNLKLVDNEIWAMMREGEAEKQKQYAALIWTSSPLTDDDLQKISVINDMEIVQNTPIRVLHRRSPLERKRIIHWMEIEKVEGSSNYYLLHLCTQAGTYIKEFVHGDLGRTNPSIGSMLRCRAEILQLDVTDVKMDLLQ

SEQ ID NO: 6098 - protein, 77 aa, Triticum aestivum
RRSPLERKRIIHWMEIEKVEGSSNYYLLHLCTQAGTYIKEFVHGDLGRTNPSIGSMLRCRAEILQLDVTDVKMDLLQ

SEQ ID NO: 6099 - protein, 79 aa, Triticum aestivum
LHRRSPLERKRIIHWMEIEKVEGSSNYYLLHLCTQAGTYIKEFVHGDLGRTNPSIGSMLRCRAEILQLDVTDVKMDLLQ

SEQ ID NO: 6100 - protein, 308 aa, Avena sativa
KRKTESREGNDTRRNSTYDDKQILRETDSFIHKTLEGIKDQEFCSLFQLPPEKVFKPCHLVISCLRSPIYIGGRYLKLSRNVSQSCWIIDDERMGEASVEEIIGENVRAICKGDGYKFHAAGREDIDVRMLGSGRPFLIEVLNVRSIPSAVDVQQIAENINSSEKKYVRVRNLKLVDNEIWAMMREGEAEKQKQYAALIWTSSPLTDDDLQKISAVKDMEIIQNTPIRVLHRRSPLERKRIIHWMEIEKVEGSSNYCLLHLCTQAGTYIKEFVHGDLGRTNPSIGAMLGCRAEILQLDVTDVKMDLLQ

SEQ ID NO: 6101 - protein, 166 aa, Setaria italica
NVRSIPSEIEVQQIEDRINNSEKKYVRVRNLKLVGNEIWTMMREGESEKQKQYTALIWTSRELAENDLHNISVTKDMEIVQKTPIRVLHRRSPLERKRIIHWMEIEKVKGSSNYYLLHLCTQAGTYIKEFVHGDLGRTHPSIGAIFGCRAEILQLDVTDVKMDFLQ

SEQ ID NO: 6102 - protein, 541 aa, Sorghum bicolor
EASASAEAEARSILERAAESSFPPLHAVHHLLSVGVCVRCILRLLGAYSSACSYASLTASVLHSFLEEHDDSMKGDSCPCLSMNDAYCSVCLGVLLPAFHRDEGLETPNGISHIDNISSMISQVVQREGYQVDEFSLEISLPPVIAANERAIRLYMKQKYVNENWFKDKMFPQQTISVKEALRLLIAPSLEKLTNAKHGNNSFRIRLAYTHGDASQKLHSLLPNEHSRKRKTDSRNGGDTSNEAHKRNSADGNNKQSSESDSFIYKTLEGIQDQEFCNVFQLPPEKVFKPCHLVISCLRSPIFLGGRYLKLSRNVSQSCWIIDDERMGEASVEEIVGENVRAICRGDSCKFHAAGREDIDVRMLGSGRPFLVEVLNVRSIPSETEVQQIEERINNSEKKYVRIRNLKLVGNEIWTMMREGEAEKQKQYTALIWTSRDLTEDDLHNISITKDMEIVQKTPIRVLHRRSPLERKRIIHWMEIEKVAGSSTYYLLHLCTQAGTYIKEFVHGDLGRTHPSIGAILGCRAEILQLDVTDVKMDFLQ

SEQ ID NO: 6103 - protein, 181 aa, Panicum virgatum
  misc_feature (99)..(99): Xaa can be any naturally occurring amino acid
STDAWIWSSISCELLNVRSIPSEIEVQQIEDRINNSETKYVRVRNLKLVGNEIWSMMREGEAEKQKQYAALIWTSRELAENDLHNISVTKEMEIVQKTXIRVLHRRSPLERKRIIHWMEIEKVAGGSNYYLLQLCTQAGTYIKEFVHGDLGRTHPSIGTILGCRAEILQLDVTDVKMDFLQ

SEQ ID NO: 6104 - protein, 536 aa, Zea mays
MEAEARNILERAAESSFPPLHAVHHLLSVGVCVRCILRLLGAYSSACSYACLTASVLHSFLEEHDESIKGGSCPCLSMNDAYCSVCLGVLLPTFHRDEGLETPNGISHIDNMSSVISQAVHGESYQVDEFSLEISLPPVIAANERAVRLYMKQKYGNENWFKDKMFAQQTMSVKEALRLLIAPSLEKLMNAKHGNNSFRIRLTYTHGDASQKLHSLLPNEHSRKRKPDSRKGGDASNEAHKRNSADGNPIQTSESDSFIYKSLEGIQDQEFCNAFQLPPEKVFKPCHLLISCLRSPTYLGGRYLKLSRNVSQSCWIIDDERMGEASVEEIIGENVRAICRGDSCKFHAAGREDIDVRMLGSGRPFLVEVLNVRSIPSETEVQQIEERINNSEKKYVIVRNLKLVDNEIWTMMREGEAEKQKQYTALIWTSRDLTDDDLHNISIMKEMEIVQKTPIRVLHRRSPLERKRIIHWMEIEKITGSSNYYLLHLCTQAGTYIKEFVHGDLGRTHPSIGAIIGCRAEILQLDVTDVKMDFLP

SEQ ID NO: 6105 - protein, 536 aa, Oryza sativa
MAAAAEVDAEARSILERAAASSFPPLHAIHHLLSVGVCVRCIFRFFGAFSYAAPCLSLTASVLHSFLEEHDDSAKSGSCSCLSKDEAYCSICFGVLLPTCYQDDGVEPLRSVSPIDNVTSIISEAVQREGHQVDEFSLEISLPAVIAANDRAIRLYMKEKYGSANWFDEKIFSQQTMSVKEALRILLVPSVEKQMNVKHGNNSFRIRLTYTHDEGSQKLLRLLPNDRGRKRKTESRDGSSKRGSTDDDKQILSESDAFINKNLEGIQDQDFRSLFQLPPEKVLEPCHLVISCQRSPIYIGGRYLKLSRNVSQSCWIIDDERMGEASVEEIIGENVRAICKGDGYKFHAAGREDIDVRMLGSGRPFLVEVLNVRSIPSATEVQQIADKINDSEKKHVRVRNLKLVGSEIWTMMREGEAEKQKQYAALIWTSRPLTDDDLHNISLIKDMEIVQKTPIRVLHRRSPLERKRIIHWMEIAKISGGSNYYLLHLCTQAGTYIKEFVHGDLGRTHPSVGVMLSCRAEILQLDVTDVKMDFLQ

SEQ ID NO: 6106 - protein, 179 aa, Pennisetum glaucum
MLGSGRPFLVELLNVRSIPSEIEVQQIEDRINSSEKKYVRVRNLKLVGNEIWTMMREGESEKQKQYTALIWTSRELAENDLHNISAMKDMEIVQKTPIRVLHRRSPLERKRIIHWMEIERVASDSYYYLLHLCTQAGTYIKEFVHGDLGRTQPSIGAILGCRAEILQLDVTDVKMDFLQ

SEQ ID NO: 6107 - protein, 217 aa, Cucumis sativus
MGEASVEEILGNNILPFCRGDSYKFHAAGREDLDVRMLGSGRPFLVEIQNARLLPSEMIINEIQSKINSSENKLIGVRNLKVVGSEGWALVQEGEAEKQKQYAALVWTSRPLEDADLLSISSLKDLKILQRTPIRVLHRRSPLEREKIIHWMKIEKVAESSQYYLLHLCTQAGTYIKEFVHGDLGRTHPSIGSILSCRAEILQLDVTDIKMDCHLGE

SEQ ID NO: 6108 - protein, 179 aa, Curcuma longa
MLGSERPFLMKIANSRHIPSKVDIGLISEKINNNDQNHVRVRNLSLIGNEAWTLMREGEAEKQKQYAALVWISRSLTDGDMQNISSLKDLDIIQRTPIRVLHRRSPLERNRIIHWMLIEKTSSSSQYFLLHLCTQAGTYIKEFVHGDLGRTHPSIGSILGCRAEILQLDVTDVKMDIFN

SEQ ID NO: 6109 - protein, 520 aa, Populus trichocarpa
MSSETEAAQFSNGTDAVQVISPNDDHRVTPGDDERRHLNDAVRSLPSHAVKDLLSAGGDSSSSESMESELKPEVCRICLGILQFIYRDEKEMLVKRKNGDELAASIAELIRQEGHQIDGFSLEVSIPPIIFENEQAVRLYMKKKYGSELWFQERLSECISTKDALKFAIVNPLEIILDVKSGPSYVRIRLTYTETKPSIIPSKSVDRNGGTNNGLDTVHVELVGNGTGCCDLSLGQGSPASGRSSTGLAEHESSECSNFPLERVNEPCHLVFLCYRTPIYFGGRYLKFSRNVSQTRWIIDDERMGEASIEEIIGGNILPMCQGDSYKFHAAGREDIDVRMLGSGRPFLVEVQNAREVPSEALVKEIETRMNNLGNKLVGVKNLSLVTSHSWDLMREGEAEKQKQYSALVWISRPLEDEDLQCIASHKDLQILQRTPVRVLHRRSPLERGKIIHWMKIEQITGSSQYFLLHLCTQAGTYIKEFVHGDLGRTHPSIGSILRCRAEILQLDVTDVKMDCFLAE

SEQ ID NO: 6110 - protein, 97 aa, Cucurbita pepo
ITQRPENFAVELQLRVLHRRSPLEREKIIHWMRIEKVAESSQYYLLHLCTQAGTYIKEFVHGDLGRTHPSIGSILSCRAEILQLDVTDIKMDGHLAE

SEQ ID NO: 6111 - protein, 124 aa, Catharanthus roseus
MREGEAEKEKQYAALVWISRPLNNDDLQSISLLKDMQILQKTPIRVLHRRSPLEREKIIHWMEVERIAGSSQYFLLHLCTQAGTYIKEFVHGDLGRTHPSIGSILGCRAEILQLDVTDVKMDCF

SEQ ID NO: 6112 - protein, 534 aa, Malus domestica
MANETQDASQATVNGDNAQSLCDVVRGLPSRAVVDLWSSGVCTRCILRLFGIREHDYYRSSLSRSILSSVLGDSEKHLVDSNVREPVVCRVCLGILQFTYSADNKLVVERESASELAVSISDLIRQQGFQIDGFSLEVSIPPIIQENDRIAWLYMKRKFESELWFQGKSLSECISAKDALKISLTEILETMLGCKSSISSFRIRLTYTHRIATITVDSSNEGCKRRKTGSGNGLDRINDDIKCSGFSTSEADAVVQRSFVSLQAIESPECLKLPLEQSSEPCCLEFLCYRTQIYVGGRYLKYSRNVSQSCWIIDDERMGEASVEEILGSNVLPICRGDNYKFHAAGREDIDVRMLGSGRPFLLEIQNARLVPSDDSVKSLEIAINNLENKLVGVKNLKLVDSQSWDLMREGEAEKQKQYVALVWISRPLKDEDLHFISSLKDTHIQQSTPIRVLHRRSPLEREKIIHWMRIEKIVGSSQYFLLHLCTQAGTYIKEFVHGDLGRTQPSIGSIFSCRAEILQLDVTDVKMDCFLTE

SEQ ID NO: 6113 - protein, 228 aa, Malus domestica
SQSCWIIDDERMGEASVEEILGSNVLPICRGDNYKFHAAGREDIDVRMLGSGRPFLLEIQNARLVPSDDSVKSLEIAINNLENKLVGVKNLKLVDSQSWDLMREGEAEKQKQYVALVWISRPLKDEDLHFISSLKDTHIQQSTPIRVLHRRSPLEREKIIHWMRIEKIVGSSQYFLLHLCTQAGTYIKEFVHGDLGRTQPSIGSIFSCRAEILQLDVTDVKMDCFLTE

SEQ ID NO: 6114 - protein, 286 aa, Lactuca sativa
MADESVSAPVVNDQDPAIAAADEMKLLGYAVQELPAHAVKDLFAHEVCVRCIFRLFNIHEGIYALLSPTTIYSIIKKAINSEDMAIKSTEDTVDAKSLQSSPELEVKSSICSVCLGVLQFSYLDERDTLLGKDHAEDFAMAVAESVKEKGHEIPSFTLEVSLPTLITENEQVILLYLKKKYASEVWFQEKFSSEHISVKDALKLSMTHPLEKLLGVKSGVSDFRIRLTFEHVDATSAENRIGKNQGNKRIKSDESNGLVKCSNGTMQSGDASDINSPLKKVVNLVT

SEQ ID NO: 6115 - protein, 277 aa, Cucumis melo
NSVADDCINPSQEVIFPQETIKEPCHLALTCYRTSIYMFGRYIKYSRNVSQTRWVIGEERMGEASVEEILGNNILPFCRGDSYKFHAAGREDLDVRMLGSGRPFLVEIQNARLLPSEMIINEIKSKINSPETKLVGVRNLKVVGSEGWALVQEGEAEKQKQYAALVWTSRPLEDDDFLSISSLKDLKILQRTPIRVLHRRSPLKREKIIHWMKIEKVAESSQYYLLHLCTQAGTYIKEFVHGDLGRTHPSIGSILSCRAEILQLDVTDIKMDCHLAE

SEQ ID NO: 6116 - protein, 245 aa, Rhizophora mangle
LSPVCLGGRYLKFSRNVRQTRWIIDEERMGEASVEEIIGGNILPAFWGDSYKFHAAGREDIDVRMLGSGRSFLVEIQNARQVPCDASVKQIETNINDLDKNLVGVKNLKVVTSHGWTLMHEGEAEKQKQYCALVWTSRPIEDEDLRSIASLKDMQILQRTPIRVLHRRSPLERAKIIHWMKIERIAGSSYYFLLHLCTQAGTYIKEFVHGDLGRTNPSFGSILRCRAEILQLDVTSVKMDCFLSE

SEQ ID NO: 6117 - protein, 287 aa, Helianthus annuus
TGKNQCNKRIKSDNGFAKHTNETAQIMDLKKVGQPCHMTLTCSTAPVYIGGRYLKLSRNVSQTRWIIDDERKGEASVEELIGENILPMCKGEGYKFHAAGREDIDVRMLGSGRPFLIEVQNARHLPSGASVKEMEKKINSLESNLVRVKHLQILGSQGWSLMREGETEKQKQYAALVWISRSINDNDLEAVSSLKDLKVLQRTPIRVLHRRSPLDREKIIHWMKIEKIGGSSQYFLLHLCTQAGTYIKEFVHGDLVRTHPSIGSILGCRAEILQLDVTDVKMDILNE

SEQ ID NO: 6118 - protein, 448 aa, Triticum aestivum
MMELRLNSSLHTMYKLFLSAVEYLPFSSGDASKACFEEIIERVLSRSREIKPHQYNEDFSDVAEQHHLQALQKAMIIQWLCFTPPSSIPDFEMITGKLLIRALMHSNTLFREFSLISMRRVPELPVGPHKLLAILAEPLKQKENLFSLEDQEVSDNLEEFEDWHEYYSLDATYRGWLRCEMENSSVPPEMLSAEEKDQAVAAATQTLELAFLLLEREERPWLNAVETSPFESSELVFLELHATAILCLPSGECMIPDATSCTALTSALYSTVSEEDMLHRQLKVEVKVSSKDPCCIEVALRCLATEGDGFGLHEANDGGLLAAIMAAGFKGELNRFQPGVSMEISRLDTWYSDCNGSVESTAAYIIRGLCRRCCLPETILRSMQASISLSEAGDSLDRCDKLIELVASSDSGMMHLFSQQQLQEFLIFERECFICKMELEEEQRPADG

SEQ ID NO: 6119 - protein, 493 aa, Triticum aestivum
  misc_feature (76)..(76): Xaa can be any naturally occurring amino acid
  misc_feature (95)..(95): Xaa can be any naturally occurring amino acid
  misc_feature (101)..(101): Xaa can be any naturally occurring amino acid
  misc_feature (108)..(108): Xaa can be any naturally occurring amino acid
  misc_feature (135)..(135): Xaa can be any naturally occurring amino acid
TRLVTVGDLIINMYVRYLFSEGQEELVGVYASQLERDVCIDLFVDMMELRLNSSLHTMYKLFLSAVEYLPFSSGDXSKACFEEIIERVLSRSREXKPHQYXEDFSDVXEQHHLQALQKAMIIQWLCFTPPSSIPXFEMITGKLLIRALMHSNTLFREFSLISMRRVPELPVGPHKLLAILAEPLKQKENLFSLEDQEVSDNLEEFEDWHEYYSLDATYRGWLRCEMENSSVPPEMLSAEEKDQAVAAATQTLELAFLLLEREERPWLNAVETSPFESSELVFLELHATAILCLPSGECMIPDATSCTALTSALYSTVSEEDMLHRQLKVEVKVSSKDPCCIEVALRCLATEGDGFGLHEANDGGLLAAIMAAGFKGELNRFQPGVSMEISRLDTWYSDCNGSVESTAAYIIRGLCRRCCLPETILRSMQASISLSEAGDSLDRCDKLIELVASSDSGMMHLFSQQQLQEFLIFERECFICKMELEEEQRPADG

SEQ ID NO: 6120 - protein, 356 aa, Lolium multiflorum
QMITGKLLMRTLMHSNTLFREFSLISMRRGSELPIGPHKLLAILAEPLKQKENFSLEDQEISDNLQEFEDWHEYYSLDATYRGWLRCEMENSSVPPDMLSAEEKDQAVAAVTQTLELAFLLLLREERPWLNAVEISPFESSELVFLELHATAILCLPSGECMPPDATSCTALTSALYSTVSEEEVLHRQLKVDVKVSSKDPCCIEVALRCLATEGDGFGLHEANDGGLLAAIMAAGFKGELNRFQPGVSMEISRLDAWYSDGHGSVESTAAYIIRGLCRRCCLPETILRSTQASISLSEAGDSLDHCDKLIELVASSDSGMIHLFSQQQIQEFLIFERECFICKMELEEEQIPTDG

SEQ ID NO: 6121 - protein, 554 aa, Brachypodium distachyon
MNLMSGNIAHLLDLLWSWVSPSEEDQNILRSRDDPEMIRFGAHIVLVLRYLFGEEMEDEFEEKLVTVGDLIINMYVRYLFSEQQEELVGVYASQLERDVCIDLFVEMMELRLNSSLHTMYKLFLSAVEYLPFSSGDASKACFEEIIERVLSRSREMKPSKYDEDFSDVAERHHLQALQKAMVIQWLCFTPPSSIPGFQMITGKLLIRALMHSNTLFREFSLISMRRVPELPIGPHKLLAILAEPLKQKENLFSFEDQEVSDNLREFEDWHEYYSLDATYRGWLRYEMENSSVPPEMLSAEEKDQAVAAARQTLELAFLLLLREERPWLNAAEKSPFEWTDTVFLELHATAILCLPSGECMLPDATSCTALTSALYSTVSEQDVLHRQLKVDVKVSSKDPCCIEVALRCLAKEGDGIALHEANDGGLLAAIMAAGFKGELNRFQPGVSMEISRLDAWYSDGHGSVECTAAYIIRGLCRRCCLPETILRSMQASISLSEAGDSLDHCDKLIELVASSDSGLMHLFSQQQLQEFLIFERECFISKMELEEEQIPTDG

SEQ ID NO: 6122 - protein, 319 aa, Avena sativa
MNGTQPMLSSVGPENWPYLVLDQQPRDIAALLQKLHSSDLVHETVSRACREQHRQIEMNLMSGNVAHLLDLLWSWVSPSVEDHNVSSPLRSRDDPEMIRFGAHIVLVMRYLFSEEMEDEFEEKLVTVGDLIINMYVRYLFSEQQGELVGVYASQLERDVCIDLFVEMMELRLNSSLHTMYKLFLSAVEYLPFSSGDVSKACFEEIIERVLSRSRETKPNKYSEDFSDVAERHHLQALHKAMVIQWLCFTPPSSIPGFQMITGKLLMRALMHSNTLFREFSLISMRRVSELPIGPHKLLAILAEPLKQKENFSLERSRDI

SEQ ID NO: 6123 - protein, 604 aa, Setaria italica
MEPKVGPESWPYHVLDQQPRDITALLQKLHSSDLVHETVSRACREQHRQIEMNLMSGNISHLLDLLWSWLSPAEEDQNIARISPLDDPEMIRFAAHVVLVLRYIFISDEMEDELEEKLVAVGDLIINMYVRYLFSEDQEELVGVYASQLQRDLCIDLFVEMMELRLNSSLHTMYKLFLSAVEYLPFSSGDASKACFEEIIERVLSRSRQTKPSKYDEDFSDVAHQHHLQSLQKAMVIQWLCFTPPPSIPDFQMITGKLLIRALMHREFSLISMRRVPELPAGPHKLLAILAEPLKQKENLFSLEDQEVSDNLQEFEDWHEYYSLDATYRNWLKVEMQNDAVSPEMLSAEENDQAVAAAKETLELAFLLLKKDERPWLDAVESSPFESSDPIFLELHASAMLCLPSGECMLPDATSCTALTSALYSTASEEDVLHRKLKVDIQVSSRDPCCIEVALSCLAAEGDGYGLHEANDGGLLAAIMAAGFKGELSRFQPGVSMAISRLDAWYSDGNGSVESTAAYIIRGLCRRCCLPETILRSMQACISLSAAGDSLDDCDKLIELVGSSESGMMHLFSQQQLQEFLIFERECLICKMELEEEQQLPSDG

SEQ ID NO: 6124 - protein, 557 aa, Pennisetum glaucum
MNLMSGNISHLLDLLWSWLSPSEEDHHIARPLDDPEMIRFGAHVVLVLRYIFISDEMEDELEEKLVTVGDLIINMYVRYLFSEDQEELVGVYASQLQRDLCINLFVEMMELRLNSSLHTMYKLFLSAVEYLPFSSGDASKACFEEIIERVLSRSRQTKPSKYDEDFSDVAHQHHLQSLQKAMVIQWLCFTPPPSIPDFQMITGKLLIRALMHSNTLFREFSLISMRRVPELPAGPHKLLAILAEPLKQKENLFSLENQEVSDNLQEFEDWHEYYSLDATYRNWLKVEMQNAAVSPETLSAEENDQAVAAAKETLELAFLLLKKDERPWLDAVESSPFESSDPIFLELHASAMLCLPSGECMLPDATSCTALTSALYSTASEEDVLHRKLKVDIQVSSRDPCCIEVALSCLAAEGDGYGLHEANDGGLLAAIMAAGFKGELSRFQPGVSMAISRLDAWYSDGNGSVESTAAYIIRGLCRRCCLPETILRSMQACISLSAAGDSLDDCDKLIELVGSSEYGMMHLFSQQQLQEFLIFERECLICKMELEEEQQQLPSDG

SEQ ID NO: 6125 - protein, 143 aa, Pseudoroegneria spicata
  misc_feature (15)..(15): Xaa can be any naturally occurring amino acid
EGDGFGLHEANDGGXLAAIMAAGFKGELNRFQPGVSMEISRLDAWYSDCHGSVESTAAYIIRGLCRRCCLPETILRSMQASISLSEAGDSLDRCDKLIELVASSDSGMMHLFSQQQLQEFLIFERECFICKMELEEEQGPADG

SEQ ID NO: 6126 - protein, 1000 aa, Panicum virgatum
NLEGLDGSRMFSSAKRRASLDGGSASDAAYSSARQTLKPVKMEDDMYLPHEGETSFTMFASLLDSANQGLMPFPDVILQFERTCRNVSESIRSAATGKLRVVEDKLMQQKAQLLLDEAASWSLLWYLYGKENEDLPGELFVSPSTSHQEACRFVAADLTAQLCLRIVLWLEGLASEALDLEKKVRGSHVGSYLPSSGVWHRTQRYLKRNNNDSTIVKHVDFDAPTREEAQLLPDDKKQDELLLEDIWTLLRAGRLEEASELCRSAGQAWRAATLCPFGGIDMFPSLDALLKNGKSRTLQAIELESGIGRQWRLWKWASYCASEKIAEQDGGRYEMAVYALQCSNLKRVLPICTDWESACWAMARSWLDVQVDLQLFKYQTSRSDERQLDDDMNGAQNSVGPESWPYHVLDQQPRNITALLQKLHSSDFVHETVSRACREQHRQIEMNLMSGNIAHLLDLLWSWLSPAEEDQNIARTLDDPEMIRFGAHVVLVLRYIFSDEIEDELEEKLVTVSDLIINLYVRYLFSEDQEELVGVYASQIQRDLCINLFVEMMELRLNSSLHTMYKLFLSAVEYLPFSSGDASKASFEEIIERVLSRSRQTKPSKYDEDFSDVAHQHHLQSLQKAMVIQWLCFTPPPSIPDFQMITGKLLIRALMHSNTLFREFSLISMRRVPELPAGPHKLLAILAEPLKQKENLISPEDQEVSDNLQEFEDWHEYYSLDATYRNWLKVEMQNAAVSPDMLSAEENDQAVAAAKETLELAFLLLKKDERPWLDAVESSPFEPSQPIFLELHACAMLCLPSGECMLPDATSCTALTSALYSTANEEDMLHRQLKVDVQVSSRDPCCIEVALCCLAAEGDGYGLHETSDGGLLAAIMAAGFKGELSRFQPGVSMAISRLDAWYSDGNGSVESTAAYIIRGLCRRCCLPETILRSMQACISLSAAGDSLHDCDKLIELVGSSESGMLHLFSQQQLQEFLILERECLISKMEIEEEQQLSSDS

SEQ ID NO: 6127 - protein, 1552 aa, Zea mays
MVVSTLCSRLPLLPNIIVLLLFTTISDSTNSNSDLNALLSFKSLITKDPMGALSSWDGDASNRSAPHFCRWNGVTCSSDQHGSHVTALRLRAFGLEGNISQSLGNLSHLQTLDLSNNNLEGEIPSSIGNLFALHFLNLSVNHLSGNVPQSIGRLSELEILNFRDNDIVGSIPSSVLNLTGLTMLSATENYMTGRIPDWLGNLTDLTDLNLAWNNFSGQIPQALGKLPNLARLTMQGNQLEGLISPTLFNISSLENLNLGYNKLSGSLPPDIGFTLPNIVAFSVCYNKFEGPVPSSLSNISVLQQLILHGNRFHGRIPPNIGVHGSLTNLELGNNQLQVVDTKDWDFLTPLVNCSHLKYLNLELNNISGILPNAVSNLSYELEALLMGGNQITGTVPSGIGRLQKLQILDLSDNLFTGAVPSSIGKLSSLDSLVLFSNKFDGEIPSSLGNLTKLTELVLHSNDLHGSMPPSLGNMTILESIDLSYNRLSGQIPQEILSMYSLTKFLNLSNNFFSGPISQQIRLLISLGTMDLSSNNLSGETPHTLGSCVTLQFLYLQGNLLQGQIPVELNALRGLEISILICALTGNPNLGSLMHFPDVIQQFERTCRNASESIRSAATGKLRVVEEKLMQQNAQLLLDEAASWSLWHIYGKEHEELSGELLVPPITSHQEACRFVAADITAQLCLRIILWLEGLASEALDLEKKVRGPHVGSYLPSSGVWHRTQRYLKRNNADSTIVKHVDFDAPTREGAQLLPDDKTCSPLPTHWAAALCPCIGSGALHRWMFLPNIVTGNDAITAGILLDIKPVQAVQHPQRWWNWVRQLVPHEEQQPQPREWRKKQDELLLEDIWTLLRAGRLEEASDLCRSAGQAWRVATLCPFGGINMFPSLNALHKNGKYRTLQAMELESGVGRQWRLWKWASYCASEKIAEQDGGRYEMAVYALQCSNLKRVLPICTDWESACWAMARSWLDVQVDLELSQYQTSRPEKQLDDDMNGAQSSVGPESWPYHVLDQQPHDLTALLQKLHSSDLVHETVSRACREQHRQIQMNLMSGNISHLLDLLWSWLSPAEENHNNTARPLDDPEMIRFGAHIVLVLRHLFSDGMDDELDEKLVTVGDLIINMYVRYLFSEDQEELVGIYASQLQHDLCITLFVEMMELRLNSSLHTMYKLFLSAVEYLPFSSDNVSKACFEEIIERVLSRSRQTKPTKYDGDFSDVAHQHHLQSLQKAMVIQWLCFTPPSSIPDFQMISWKLLIRALTHSNTLFREFSLISMRRVPELPAGPHKLLAILAEPLKQKENLISREDPEHEYYSLDATYRSWLKIEMMNAAVSPEMLSAEEKGQAVAAAKETLNLACSLLRNATSCTALTSALYSTVSEDDVLHRLLKVDVQVSSRDPCCIEVALRCLAAEGDGYGLHEANDGGLLAAVMAAGFKGELSRFQPGVSMAISRLDAWYSDRSGSVESTAAYIIRGLCRRCCLPETILRSMQACIALSAAGDDLDYSLDKCDELVELVGSAESGMMHLFSQQQLQEFLIFEREYLICTMEFEEDRLPCDG

SEQ ID NO: 6128 - protein, 293 aa, Pseudoroegneria spicata
TIALCGSEAQKQKYLPSLAQFKTVGCWALTEPDYGSDASSLKTSATKVPGGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGAPLAAFQLNQEKLVRMLGNIQAMLLVGWRLCKLYESGKMTPGHASLGKAWTSSKSMEVVSLGRELLGGNGILADFLVAKAFCDLEPIYSYEGTYDINSLVTGREITGIASFKPAAVAKSRL

SEQ ID NO: 6129 - protein, 225 aa, Setaria italica
VLVVLARNADTKQLNGFIVRKGAPGLKATKIENKIGLRMVQNGDIVFNKVFVPEEDRLPGVNSFQDISKVLAISRIMVAWQPIGISMGVFDMCHRYLKERKQFGVPLTAFQLIQEKLVRMLGNIQSMLLVGWRLCKLYESGKMTPGHASLGKAWNSRTAREVVSLGRELLGGNGILADFLVAKAFCDLEPIYSYEGTYDINSLVTGREITGVASFKPAALAKARL

SEQ ID NO: 6130 - protein, 439 aa, Amsonia hubrichtii
MKVPASKTQEDMYKEAKSSYFDLPALDVSLAFPQATPASIFPPCTSDYYQFDELLTPAEKVIRQRVRECMEKEVAPIMAKYWEKAEFPFEVVPKLGALHIAGGTIKGYGCPGLSVTANAIATAEVARVDASCSTFILVHSSLAMLTIGLCGSEAQKLKYLPSMAEMKAVGCWALTEPDHGSDASSLRTTARKVEGGWILEGQKRWIGNSTFADVLVICARNTTTNQINGFIVKKDAPGLQATKIENKIGLRIVQNGDILLKKVFVPDEDRLPGVNSFQDTNKVLAVSRVMVAWQPIGISMGVYDMCHRYLKERKQFGAPLAAFQLNQQKLVQMLGNIQAMLLIGWRLCKLYESGKMTPGHASLGKSWISLRARETVSLGRELLGGNGILADFLVAKAFCDLEPIYTYEGTYDINTLVTGREITGIASFKPAAASQRSRL

SEQ ID NO: 6131 - protein, 436 aa, Musa acuminata
MASSNQDDHHTASMGSHSGLPPLNISVAFPQATPASVFPPSSSDYYQFDDLLNPEEQALRKRVRDVMEKEVAPIMAVYWEKAEFPFHVIPKLATLSIAGGTIKGYGCPGLSITASAIATAEVARVDASCSTFILVHSSLAMLTIALCGSEAQKVKYLSSLAKFDTVACWALTEPDYGSDASSLRTTATKVSGGWVLDGQKRWIGNSTFADVLIVFARNTSTNQINGFIVKKGTPGLRVTKIENKIGLRIVQNGDIILNKVFVPDEDRLPGVNSFQDTGKVLAVSRVIVAWQPIGISMGVFDMCNRYLKERKQFGAPLAAFQINQEKLVRMLGNIQAMLLVGWRLCKLYESGKMTAGHASLGKAWTSLKARETVSLGRELLGGNGILADFLVAKAFCDLEPIFTYEGTYDINSMVTAREITGIASFKPAVLGRSSRL

SEQ ID NO: 6132 - protein, 439 aa, Vinca minor
MKVPASKTQEDMYKESKSSYFDLPALDVSLAFPQATPASIFPPCASDYYQLDELLTSEEKVTRQKVRECMEKEVAPIMTKYWEKAEFPFEVVPKLGALRIAGGTIKGYGCPGLSITGNAVATAEVARVDASCSTFILVHSSLAMLTIGLCGSEEQKQKYLPSLAEMRTVACWALTEPDYGSDASSLRTTATKVEGGWILEGQKRWIGNSTFADLLLIFARNTKNNQINGFIVKKDAPGLQATKIENKIGLRMVQNGDILMKNVFVPDEDRLPGVNSFQDTNKVLAVSRVMVAWQPIGISMGVYDMCHRYLKERKQFGAPLAAFQINQQKLVQMLGNIQAMLLMGWRLCKLYDSGKMTPGQASLGKSWITLRARETVSLGRELLGGNGILADFLVAKAFCDLEPIYTYEGTYDINSLVTGREITGIASFKPAASSQRSRL

SEQ ID NO: 6133 - protein, 263 aa, Nicotiana tabacum
GHTAGDASALGTTARKVEGGWILEGQKRWIGNATFADILVIFARNTSTNQINGSIVKKDAPGLQATKIENKIGLRMVQNGDILLKKVFVPDEDRLPGVNSFQDTNKVLAVSRVMVAWQPIGITMGVYDMCHRYLKERKQFGAPLAAFQINQQKLVQMLGNIQAMILVGWRLCKLYESGKMTPGHASLGKSWITLRARETVSLGRELLGGNGILAEFLVAKAFCDLEPIYTYEGTYDINTLVTGREITGLASFKPAPLRQKSRL

SEQ ID NO: 6134 - protein, 438 aa, Theobroma cacao
MALLSKFRDETDKSAKSSYFNLPPLDVSVAFPQATPASTFPPPASDYYQFDDLLSPEEQAIRKKVRECMEKEVAPVMTEYWEKAEFPFQIVPKLAALRIAGGTIKGYGCPGLSITGSAISTAEVARVDASCSTFILVHSSLAMLTIALCGSEEQKQKYLPSLAQLKTIACWALTEPDYGSDASALKTTATKVKGGWMLEGQKRWIGNSTFADVLVIFARNTTTNQINGYLVKKDSPGLTATKIANKIGLRIVQNGDILLKKVFVPDEDRLPGVNSFQDTSKVLAVSRVMVAWQPIGISMGVYDMCQRYLKERKQFGAPLAAFQINQQKLALMLGNVQAMTLVGWRLCKLYEGGKMTPGQASLGKSWITLKARETVSLGRELLGGNGILADFLVAKAFCDLEPIYTYEGTYDINSLVTGREITGFASFKPAALSQRSRL

SEQ ID NO: 6135 - protein, 438 aa, Gossypium hirsutum
MTVHSQIQDETGRSVKPSYFNSPPLDVSVAFPQATPASTFPPLASDYYQFNDLLSPEEQALRKKVRECMEKEVAPIMAEYWEKAEFPFQIVPKLGALHISGGTIKGYGCPGLSLTGSAIAMAEVARVDASCSTFILVHSSLAMLTIALCGSEEQKQKYLPSLAQLKTVACWALTEPDYGSDASSLKTTATKVEGGWILEGQKRWIGNSTFADVLVIFARNTTTNQINGYLVKKDSPGLTATKIPNKIGLRIVQNGDILLKKVFVLDEDRLPGVNSFQDTSKVLAVSRVMVAWQPIGISMGVYDMCARYLKERKQFGAPLAAFQINQQKLARMLGNIQAMTLVGWRLCKLYEEGKMTPGHASLGKSWITSMARETAALGRELLGGNGILADFLVAKAFCDLEPIYTYEGTYDINSLVTGREITGFASFKPASVSQRSRL

SEQ ID NO: 6136 - protein, 370 aa, Orobanche aegyptiaca
MEKEVAPIMAKYWEKAEFPFEVVPKLGALRVAGGSIKGYGCPNLSITANAIATAEVARVDASCSTFILVHSSLAMLTIALCGSEEQKQKYLPSLAELKTVGCWALTEPDYGSDASALRTTARKVEGGWILDGQKRWIGNSTFADVLLIFARNTATNQINGFILKKNTPGLQATKIENKIGLRIVQNGDILMKGVFVPDEDRLPGVNSFQDTNKVLAVSRVMVAWQPIGISMGVYDMCHRYLKERKQFGAPLAAFQLNQQKLVRMLGNVQAMLLVGWRLCKLYESGKMTPGHASMGKSWISLKARETVSLGRELLGGNGILADFLVAKAFCDLEPIFTYEGTYDINTLVTGREITGIASFKPPALSNRSRL

SEQ ID NO: 6137 - protein, 437 aa, Prunus persica
MTVPPNQDDVNKNERTNYFNSPAMDVSLAFPQATPASTFPPCTSDYYQFDDLLTPEEQAVRLRVRQCLEKDVAPIMAEYWEKAEFPFHVIPKFGALRIAGGTIKGYGCPGLSITANAFATAEIARVDASCSTFFLVHSSLAMLTIALCGSEAQKQEYLPSLAELKTVACWALTEPDYGSDASALRTTATKVEGGWILEGQKRWIGNSTFADVLVIFARNTTTNQINGYIVKKNVPGLTATKIENKIGLRIVQNGDILLKKVFVPDEDRLPGVNSFQDTSKVLAVSRVMVAWQPIGLSMGVYDMCHRYLKERKQFGAPLAAFQINQEKLVRMLGNVQAMVLIGWRLCKLYEKGKMTPGHASLGKAWITLRARETVALGRELLGGNGILADFLVAKAFGDLEPIYTFEGTYDINALVTGREITGIASFKPAASSQRSRL

SEQ ID NO: 6138 - protein, 296 aa, Plantago ovata
MLTIALCGSEEQKQKYLPSLAELKTVACWALTEPDYGSDASALKTTARKVDGGWILNGQKRWIGNSTFADILVIFARNPSTNQINGFIVKKNSPGLKATKIENKIGLRMVQNGDILLKNVFVPDEDKLPGVKSFQDTSKVLAVSRVMVAWQPIGITMGVYDMCHRYLKERKQFGAPLAAFQINQQKLVRMLSNIQAMLLMGWRLCKLYESDKMTPGQASLGKSWISLTARETVSIGRELLGGNGILADFLVAKAFCDLEPIYTYEGTYDINTLVTGREITGIASFKPAALGNRSRL

SEQ ID NO: 6139 - protein, 240 aa, Platanus occidentalis
MAKSVGLEIVLLLICWLFFARNTNTNQINGFIVKKDAPGLTATKIENKIGLRIVQNGDIVLKKVFVPDEDRLPGVNSFQDTSKVLAVSRVMVAWQPIGVAMGVYDMCLRYLKERKQFGAPLAAFQINQEKLVRMLGNIQAMFLLGWRLCKLYESEKMTPGHASLGKAWISLKARETVSLGRELLGGNGIIADFLVAKAFGDLEPIYTFEGTYDINSLITGREITGIASFKPAVSTQRSRL

SEQ ID NO: 6140 - protein, 296 aa, Tabernaemontana elegans
MLTIALCGSEAQKQKYLPSLAEVNTVACWALTEPDYGSDASSLRTTARKVEGGWILEGQKRWIGNSTFADVLVIFARNTTTNQINGFIVKKDAPGLQATKIENKIGLRIVQNGDILLKKVFVPDEDRLPGVNSFQDTNKVLAVSRVMVAWQPIGISMGVYDMCHRYLKERKQFGAPLAAFQINQQRLVQMLGNIQAMILVGWRLCKLYECGKMTTGHASLGKSWITLRARETVSLGRELLGGNGILSDFLVAKAFCDLEPIYTYEGTYDINTLVTGREITGIASFKPAASGQRSRL

SEQ ID NO: 6141 - protein, 435 aa, Fragaria vesca
MTIPPNQDDGKARTTYFNSPALDVSLAFPQATPASKFPPCTSDYYQSNDLLTPEEQALRMRVRHCVEKEVAPIMAEYWEKAKFPFHIIPKLGALRIAGGTIKGYGCPGLSVTANAIATAEVARVDASCSTFILVHSSLAMLTIALCGSEAQKQKYLPSLAEFKTVACWGLTEPDYGSDASALKTTATKVEGGWILDGQKRWIGNATFADVLVIFARNTTTNQINGYIVNKNVPGLKATKIENKIGLRMVQNGDILLKQVFVPDEDRLPGVNSFQDTSKVLAVSRVMVAWQPIGISMGVYDMCHRYLKERKQFGAPLAAFQINQEKLVHMLGNVQAMILIGWRLCKLYEAGKMTPGQASMGKSWITVKARETVALGRELLGGNGILSDFLVAKAFCDLEPIYTYEGTYDINSLVTGREITGVASFKPAPSSKRSRL

SEQ ID NO: 6142 - protein, 436 aa, Arabidopsis thaliana
MAVLSSADRASNEKKVKSSYFDLPPMEMSVAFPQATPASTFPPCTSDYYHFNDLLTPEEQAIRKKVRECMEKEVAPIMTEYWEKAEFPFHITPKLGAMGVAGGSIKGYGCPGLSITANAIATAEIARVDASCSTFILVHSSLGMLTIALCGSEAQKEKYLPSLAQLNTVACWALTEPDNGSDASGLGTTATKVEGGWKINGQKRWIGNSTFADLLIIFARNTTTNQINGFIVKKDAPGLKATKIPNKIGLRMVQNGDILLQNVFVPDEDRLPGVNSFQDTSKVLAVSRVMVAWQPIGISMGIYDMCHRYLKERKQFGAPLAAFQLNQQKLVQMLGNVQAMFLMGWRLCKLYETGQMTPGQASLGKAWISSKARETASLGRELLGGNGILADFLVAKAFCDLEPIYTYEGTYDINTLVTGREVTGIASFKPATRSRL

SEQ ID NO: 6143 - protein, 439 aa, Citrus sinensis
MTIHSSKHQDDVDKNARSSYFNLPALDISVAFPQATPASKFPPCASDYYQFDDLLTSEEQAVRMKVRECMEKEIAPIMAEYWEKAEFPFHVIPKLGALRVAGGTIKGYGCPGHSVTGAAIAIAEIARVDASCSTFILVHSSLAMLTIALCGSEEQKQKYLPSLAQLNTIACWALTEPAYGSDASALNTTATKVEGGWILEGQKRWIGNSTFADVLVIFARNTTTNQINGYLVKKDAPGLTVTKIENKIGLRIVQNGDILLKKVFVPDEDRLPGVNSFQDTSKVLAVSRVMVAWQPIGISMGVYDMCHRYLKERKQFGAPLAAFQINQQKLVQMLGNIQAMILVGWRLCKLYEKGAMTPGHASLGKSWITARARETVALGRELLGGNGILSDFLVAKAFCDIEPIYTYEGTYDINTLVTGREVTGIASFKPVALATRSRL

SEQ ID NO: 6144 - protein, 150 aa, Curcuma longa
MVAWQPIGIAMGVFDMCNRYLKERKQFGAPLAAFQLNQEKLVRMLGNIQAMLLIGWRLCKLYESGKMTAGQASLGKAWTTLKARETVSLGRELLGGNGILADFLVAKAFCDLEPIYTYEGTYDINSMVTAREITGISSFRPAALRTSSRL

SEQ ID NO: 6145 - protein, 446 aa, Vitis vinifera
MTIYSSNNAGYSSNNPDDSEKAKKGSYFGLPSLDVSVAFPQATPASIFPPCASDYYQFDDLLTPEEQALRMKVRKCVEKEIAPIMTEYWEKAEFPFHVVPKLAALRIAGGTIKGYGCPGLSVTASAITTAEVSRVDASCSTFILVHSSLAMLTIALCGSEAQKQKYLPSLAQLNTIACWALTEPDYGSDASSLKTTATKVEGGWILEGQKRWIGNSTFADVLIIFARNTTTNQINGYIVKKGAPGLTATKIQNKIGLRIVQNGDIQFKKVFVPDEDRLPGVNSFQDTNKVLAVSRVMVAWQPIGISMGAYDMCHRYLKERKQFGAPLAAFQINQQKLVEMLGNIQAMTLVGWRLCKLYEKGKMTPGHASLAKAWITLKARETLALGRELLGGNGILADFLVAKAFCDLEPIYTYEGTYDINTLVTGREITGIASFKPAALNRRSRL

SEQ ID NO: 6146 - protein, 224 aa, Petunia hybrida
IIFARNISTNQINGFIIKKDAPGMQATKMENKIGLRIVQNGDILLNKVFVPDEDRLPGVNSFKDTNKVLAVSRVTVAWMPIGIAMGVYDMCHRYLKERKQFGAPLAAFQINQLKLVQMLGNIQAMILVGWRLCKLYESGKMTPGQASLGKSWTTLRARETVSLGRELLGGNGILADFLVAKAFCDLEPIYTYEGTYDINTLVTGREITGFPSFKPATLRQKSRL

SEQ ID NO: 6147 - protein, 439 aa, Aquilegia formosa
MTINPSSQKPDNNDSKYDVKIGLPALEVSLAFPQATPASTFPPCASDYYQFDDLLTSEEQNLRRHVRAIMEKEIAPIMTEYWEKAEFPFHAIPKLADLRVAGGTVKGYGNPGLSITGSAIATAEVARVDASCSTFILVHSSLAMLTIALCGSEAQKQKYLPSLAQFRTVACWALTEPDYGSDASSLRTTATKVDGGWIVEGQKRWIGNSTFADVLVVFARNRTTNQINGFIVNKGAPGLKVTKIENKIGLRMVQNGDILLQKVFVPDEDRLPGVNSFQDTSKVLAVSRVMVAWQPIGIAMGVYDMCLRYLKERKQFGVPLAAFQINQEKLVRMLGNVQAMFLVGWRLCKLYESGKMTAGHASMGKAWITLRARETVSLGRELLGGNGILADFLVAKAFCDLEPIFTYEGTYDINSLVTGREVTGVAAFKPAALKQHSRM

SEQ ID NO: 6148 - protein, 188 aa, Aquilegia formosa
MVQNGDILLQKVFVPDEDRLPGVNSFQDTSKVLAVSRVMVAWQPIGIAMGVYDMCLRYLKERKQFGVPLAAFQINQEKLVRMLGNVQAMFLVGWRLCKLYESGKMTAGHASMGKAWITLRARETVSLGRELLGGNGILADFLVAKAFCDLEPIFTYEGTYDINSLVTGREVTGVAAFKPAALKQHSRM

SEQ ID NO: 6149 - protein, 194 aa, Cenchrus ciliaris
KNTIGLRMLQNGDIILNKVFVPEEDRLPGINSFRDIDKVFAISRVTGTWQLIGISMGVFDMCHRYLKERKQFGAPLAAFQLNQEKLVRMLGNIQAMVLVGWRLCKLYESGKMTSGHSSLGKAWISRKAREVVSLGRELLGGNGILADFLVAKAFCDLEPIFSYEGTYDINSLVTGREITGVASFKPAMLAKSRL

SEQ ID NO: 6150 - protein, 264 aa, Brassica juncea
LTEPDNGSDASALTTTATKVEGGWVLEGQKRWIGNSTFADLLVILARNTTTNQVNGFLVQKDAPGLTVTKIPNKIGLRIVQNGDILLKNVFVPDEERLPGVNSFQDTSKVLAVSRVMVAWQPIGISMGVYDMCHRYLKERKQFGAPLAAFQINQQKLVKMLGNVQAMFLMGWRLCKLYETGQMTPGQASLGKAWISSKARETASLGRELLGGNGIVADFLVAKAFCDLEPIYTYEGTYDINTLVTAREVTGIASFKPAASRSRL

SEQ ID NO: 6151 - protein, 150 aa, Lippia dulcis
MVAWQPIGITMGVYDMCHRYLKERKQFGAPLAAFQINQQKLVQMLSNIQAMFLIGWRLCKLYESGKMTPGHASMGKSWITLKARETVSLGRELLGGNGILADFLVAKAFCDLEPIYTYEGTYDINTLVTGREITGFASFKPPPLSKRSRL

SEQ ID NO: 6152 - protein, 442 aa, Malus domestica
MTVPPNQDDVKKNERTNYFNSPALDVSLAFPQATPASTFPPCASDYYQFDDLLTPEEQAMRLRVRKCMEKDVAPIMAEYWEKAEFPFQIIPKLGALRIAGGTIKGYGCPGLSITASAFATAELARVDASCSTFVLVHSSLAMLTIALCGSEAQKQKYLPSLAEFKTVACWGLTEPDYGSDASALRTTATKVEGGWILEGQKRWIGNSTFADVLVIFARNTTTNQINGFIIKKNAPGLAATKIENKIGLRIVQNGDILLNKVFVPDEERLPGVNSFQDTSKVLAVSRVMVAWQPIGLSMGVYDMCHRYLKERKQFGAPLAAFQINQEKLVRMLGNVQAMVLIGWRLCKLYEAGKMTPGHASMGKAWITLRARETVALGRELLGGNGILSDFLVAKAFGDLEPIYTFEGTYDINSLVTGREVTGIASFKPPASSQRSRLEQCNF

SEQ ID NO: 6153 - protein, 439 aa, Brassica oleracea
  misc_feature (216)..(216): Xaa can be any naturally occurring amino acid
  misc_feature (218)..(218): Xaa can be any naturally occurring amino acid
  misc_feature (231)..(231): Xaa can be any naturally occurring amino acid
  misc_feature (233)..(233): Xaa can be any naturally occurring amino acid
  misc_feature (239)..(239): Xaa can be any naturally occurring amino acid
  misc_feature (261)..(261): Xaa can be any naturally occurring amino acid
  misc_feature (274)..(274): Xaa can be any naturally occurring amino acid
MTVLSSTDRDEAEKKVKSSYIDLPAMDVSVAFPQATPASKFPPCTSDYYHFNELLTPEEQAVRKRVREFMEKEVAPIMTEYWEKAEFPFHIIPKLGALGIVGGSIKGYGCPGLSITANAIATAEISRVDASCGTFNLVHTSLGMLTIALCGSEEQKHKYLPSLAQMKTVTCWALTEPDNGSDASALQTTATKVGGGWVLTGQKRWIGNSTFADLLXIXARNTTTNQVNGFXVXKDAPGXTVTKIPNKIGLRIVQNGDILLXNVFVPDEERLPGXNSFQDTSKVLAVSRVMVAWQPIGISMGVYDMCHRYLKERKQFGAPLAAFQINQQKLVKMLGNVQAMFLMGWRLCKLYESGQMTPGQASLGKAWISSKARETASLGRELLGGNGIVGDFLVAKAFCDLEPIYTYEGTYDINTLVTAREVTGIASFKPAASRSRSRL

SEQ ID NO: 6154 - protein, 206 aa, Citrus sinensis
KDAPGLTVTKIENKIGLRIVQNGDILLKKVFVPDEDRLPGVNSFQDTSKVLAVSRVMVAWQPIGISMGVYDMCHRYLKERKQFGAPLAAFQINQQKLVQMLGNIQAMILVGWRLCKLYEKGAMTPGHASMGKSWITARARETVALGRELLGGNGILSDFLVAKAFCDIEPIYTYEGTYDINTLVTGREVTGIASFKPVALATRSRL

SEQ ID NO: 6155 - protein, 439 aa, Mimulus guttatus
MKVPPSEAQEDMYRKEKSSYFDSPALDVSVAFPQATPASVFPPSVSDYYQFDDLLTPEEQAVRIKVRECMEKEVAPIMTKYWEKAEFPFEVVPKLGALRVAGGSIKGYGCPNLSITANAIATAEVARVDASCSTFILVHSSLAMLTIGLCGSEAQKQKYLPSLAELKTVACWALTEPDYGSDASALKTTARKVEGGWILDGQKRWIGNSTFADVLVIFARNLTTNQINGYIVKKDTPGLQATKIENKIGLRIVQNGDIVMKNVFVPDEDRLPGVDSFQDTNKVLAVSRVMVAWQPIGISMGVYDMCHRYLKERKQFGVPLASFQINQQKLVRMLGNVQAMFLVGWRLCKLYESGKMTPGHASMGKSWISLKARETVSLGRELLGGNGILSDFLVAKAFCDLEPIYTYEGTYDINTLVTGREITGIASFKPAASSNRSRL

SEQ ID NO: 6156 - protein, 438 aa, Carica papaya
MTLPSSTNPDGNKRERSAYFNSPALDISVAFPQATPASIFPPCASDYYQFDDLLTPEEQALRLKVRECMEKEVAPVMTEYWEKAEFPFHVVPKLAALRIAGGTIKGYGCPGLSITASAIATAEVARVDASCSTFILVHSSLAMLTIALCGSESQKQKYLPSLARFNTVACWALTEPDYGSDASALRTTATKVEGGWVLEGQKRWIGNSTFADLLVIFARNTSTSQINGFIVKKDAPGLTATKIQNKIGLRMVQNGDILLQKVFVPDEDWLPGINSFQDTNKVLAVSRVMVAWQPIGISMGIYDMCHRYLKERKQFGAPLAAFQINQQKLVQMLGNVQAMVLVGWRLCKLYEKGKMTPGQASLGKSWITLRARETAALGRELLGGNGILADFLVAKAFCDLEPIYTYEGTYDINSLVTGREVTGLASFKPAMLNKRSRL

SEQ ID NO: 6157 - protein, 188 aa, Fagopyrum esculentum
MVQNGDILLKEVFVPDEDRLPGVNSFQDTSKVLAVSRVMVAWQPIGISMGVYDMCHRYLHERKQFGAPLAAFQINQQKLTEMLGNVQAMYLMGWRLCKLYEEGKMTAGHASLGKAWISSKARETAALGRELLGGNGILADFLIGKAFCDLEPIYTYEGTYDINTLVTAREITGIASFKPAVSVKRSRL

SEQ ID NO: 6158 - protein, 440 aa, Arnica chamissonis
MAIQLSKPQDDQNKDSKSLYFNHPALDVSMAFPQATPASIFPPCTSDYYQFADLLTPEEQSLRLKVRECVERDVAPVMTKYWEKAEFPFEIVPKLGALNIAGGTIKGYGCPGLSVTANALATAEIARVDASCSTFILVHSSLAMLTISLCGSEIQKHKYLPSLAKLDTIACWGLTEPDYGSDASGLRTTATKVEGGWVIEGQKRWIGNSTFADVLVIFAKNKNTNQINGFIVKKNAPGLQATKIENKIGLRMVQNGDILLQKVFVPDEDRLPGINSFQDTSKVLAVSRVMVAWQPIGITMGVYDMCHRYLQERKQFGAPLAAFQINQQKLVQMLSNVQAMFLMGWRLCKLYESGKMTPGQASLGKSWITLRARETVALGRELLGGNGILSDFLVAKAFNDLEPIYTYEGTYDINTLVTGREITGIASFKPVAKTTLTSRL

SEQ ID NO: 6159 - protein, 339 aa, Silene vulgaris
LRVAGGTIKGYGCPGLSVTANAIATAEVARVDASCSTFILVHSSLAMLTIALCGSEEQKQKYLPSLAEFKTVACWGLTEPDNGSDASALNTTATKVDGGWLIEGQKRWIGNSTFADVLVIFARNTTTNQINGFIVKKDAPGLTSTKIENKIGLRMVQNGDIVLKKVFVPDEDRLTGVNSFQDTSKVLAVSRVMVAWQPIGICMGVYDMCHRYLKERKQFGVPLAAFQLNQQKLVQMLGNVQAMLLIGWRLCKLYESGKMTAGHASLGKSWITVKARETVALGRELLGGNGILGDFLVAKAFCDLEPIYTYEGTYDINTLITGREVTGIASFKPASRSRL

SEQ ID NO: 6160 - protein, 436 aa, Arabidopsis lyrata
MTVLSSADRASTEKKVKSSYFDLPPMEMSVAFPQATPASTFPPCTSDYYHFNDLLTPEEQAIRKKVRECMEKEVAPIMTEYWEKAEFPFHITPKLGAMGVAGGSIKGYGCPGLSITANAVATAEIARVDASCSTFILVHSSLGMLTIALCGSEAQKEKYLPSLAQLNTVACWALTEPDNGSDASGLGTTATKVEGGWKIKGQKRWIGNSTFADLLIIFARNTTTNQINGFIVKKDAPGLKATKIPNKIGLRMVQNGDILLQNVFVPDEDRLPGVNSFQDTSKVLAVSRVMVAWQPIGISMGIYDMCHRYLKERKQFGAPLAAFQLNQQKLVQMLGNVQAMFLMGWRLCKLYETGQMTPGQASLGKAWITSKARETASLGRELLGGNGILADFLVAKAFCDLEPIYTYEGTYDINTLVTGREVTGLASFKPATRSRL

SEQ ID NO: 6161 - protein, 177 aa, Elaeis guineensis
  misc_feature (57)..(57): Xaa can be any naturally occurring amino acid
FVPDEDRLPGVNSFQDTNKQVLAVSRVMVAWQPIGISMGVFDMCHRYLKERKQFGAXLAAFQINQEKLVRMLGNIQAMLLVGWRLCKLYESGKMTPGHASMGKAWTSLKARETVSLGRELLGGNGILADFLVAKAFCDLEPIFSYEGTYDINSLVTAREITGFASFKPAALGKASRL

SEQ ID NO: 6162 - protein, 439 aa, Brassica rapa
MTVLSSRDRDEAEKKVKSSYFDLPAMDVSVAFPQATPASKFPPCTSDYYHFNELLTPEEQDVRKRVREFMEKEVAPIMTEYWEKAEFPFHIIPKLGALGVVGGSIKGYGCPGLSITANAIATAEISRVDASCGTFNLVHTSLGMLTIALCGSEEQKQKYLPSLAQLKTVTCWALTEPDNGSDASALQTTATKVEGGWVLTGQKRWIGNSTFADLLIILARNTTTNQVNGFIVKKDAPGLTVTKIPNKIGLRIVQNGDILLQNVFVPDEERLPGLNSFQDTSKVLAVSRVMVAWQPIGVSMGVYDMCHRYLKERKQFGAPLAAFQINQQKLVKMLGNVQAMFLMGWRLCKLYESGQMTPGQASLGKAWISSKARETASLGRELLGGNGIVGDFLVAKAFCDLEPIYTYEGTYDINTLVTAREVTGIASFKPAASRSRSRL

SEQ ID NO: 6163 - protein, 242 aa, Theobroma cacao
  misc_feature (119)..(119): Xaa can be any naturally occurring amino acid
  misc_feature (131)..(131): Xaa can be any naturally occurring amino acid
  misc_feature (144)..(144): Xaa can be any naturally occurring amino acid
  misc_feature (158)..(158): Xaa can be any naturally occurring amino acid
  misc_feature (180)..(181): Xaa can be any naturally occurring amino acid
MLEGQKRWIGNSTFADVLVIFARNTTTNQINGYLVKKDSPGLTATKIANKIGLRIVQNGDILLKKVFVPDEDRLPGVNSFQDTSKVLAVSRVMVAWQPIGISMGVYDMCQRYLKERKQXGAPLAAFQINQXKLALMLGNVQAMXLVGWRLCKLYEGGXMTPGQASLGKSWITLKARETVXXGRELLGGNGILADFLVAKAFCDLEPIYTYEGTYDINSLVTGREITGFASFKPAALSQRSRL

SEQ ID NO: 6164 - protein, 439 aa, Brassica napus
MTVLSSRDRDDAEKKVKSSYFDLPAMDVSVAFPQATPASKFPPCTSDYYHFNELLTPEEQAVRKRVREFMEKEVAPIMTEYWEKAEFPFHIIPKLGALGVVGGSIKGYGCPGLSITANAIATAEISRVDASCGTFNLVHTSLGMLTIALCGSEAQKHKYLPSLAQMKTVTCWALTEPDNGSDASALQTTATKVEGGWVLTGQKRWIGNSTFSDLLIILARNTTTNQVNGFIVKKDAPGLTVTKIPNKIGLRIVQNGDILLQNVFVPDEERLPGLNSFQDTSKVLAVSRVMVAWQPIGVSMGVYDMCHRYLKERKQFGAPLAAFQINQQKLVKMLGNVQAMFLMGWRLCKLYESGQMTPGQASLGKAWISSKARETASLGRELLGGNGIVGDFLVAKAFCDLEPIYTYEGTYDINTLVTAREVTGIASFKPAASRSRSRL

SEQ ID NO: 6165 - protein, 439 aa, Brassica napus
MTVLSSTDRDEAEKKVKSSYFDLPAMDVSVAFPQATPASKFPPCTSDYYHFNELLTPEEQAVRKRVREFMEKEVAPIMTEYWEKAEFPFHIIPKLGALGVVGGSIKGYGCPGLSITANAIATAEISRVDASCGTFNLVHTSLGMLTIALCGSEEQKHKYLPSLAQLKTVTCWALTEPDNGSDASALQTTATKVEGGWVLTGQKRWIGNSTFADLLIILARNTTTNQVNGFIVKKDAPGLTVTKIPNKIGLRIVQNGDILLQNVFVPDEERLPGLNSFQDTSKVLAVSRVMVAWQPIGVSMGVYDMCHRYLKERKQFGAPLAAFQINQQKLVKMLGNVQAMFLMGWRLCKLYESGQMTPGQASLGKAWISSKARETASLGRELLGGNGIVGDFLVAKAFCDLEPIYTYEGTYDINTLVTAREVTGIASFKPAASRSRSRL

SEQ ID NO: 6166 - protein, 428 aa, Capsicum annuum
MHKEAKSSYFDMPALDVSVAFPQATPASNFPPCTSDYYQLADLLTPEEQAVRMKVRECMEKEVAPIMAKYWEKAEFPFEVIPKFAALHIAGGTIKGYGCPGSSITGSAVAAAEVARVDASCSTFILVHSSLAMLTIGLCGSEMQKQKYLPSLAELDTIACWGLTEPDYGSDASGLGTTARKVEGGWILEGQKRWIGNSTFANILVIFARNTSTNQINGFIVKKDAPGLQATKMENKIGLRIVQNGDILLKKVFVPDEDRLPGVNSFQDTNKVLAVSRVMVAWQPIGIAMGVYDMCHRYLKERKQFGAPLAAFQINQQKLVQMLSNIQAMILVGWRLCKLYESGKMTPGHASLGKSWNTLRARETVALGRELLGGNGILSDFHVAKAFCDLEPIYTFEGTYDINTLVTGREITGLASFKPAPSRQKSRL

SEQ ID NO: 6167 - protein, 439 aa, Solanum phureja
MKVPATKIQEEMSIEAKSSYFDLPALDVSVAFPQATPASVFPKCTSDYYQLDDLLTSEEKAIRLKVRECMEKEIAPIMTKYWEKAEFPFEVIPKLGALHISGGTIKGYGCPGLSVTGSAIALAEIARVDASCSTFILVHSSLAMLTIGLLGSEMQRQKYLPSLADLSSISCWGLTEPDYGSDASALRTTATKVEGGWILEGQKRWIGNSTFADVLVIFARNTATNQINGFIVQKDAPGLQSTKIENKIGLRMVQNGDILFKKVFVPDEDRLPGVNSFKDTSKVLAVSRVMVAWLPIGIAMGVYDMCHRYLKERKQFGAPLAAFQLNQQKLVQMLGNIQAMLLVGWRLCKLYESGKMTPGQASLGKSWNTLRARETVSLGRELLGGNGILADFLVAKAFCDLEPIYTFEGTYDINTLVTGREITGLPSFKPAPLRPQSRL

SEQ ID NO: 6168 - protein, 258 aa, Amaranthus tuberculatus
MEVMRVGYKQLLQRVAGGWILDGQKRWIGNSTFADLLIIFARNPATNQINGYIVKKDAPGLTATKIQNKIGLRIVQNGDIILKKVFVPDEDRLPGVNSFQDTNKVLAVSRVMVAWQPIGISMGVYDMCHRYLKERKQFGAPLAAFQINQQKLVQMLGNVQAMFLIGWRLCKLYESGKMTPGQASLGKSWITSKARETVALGRELLGGNGILAEFLVAKAFCDLEPIYTYEGTYDINTLVTAREVTGIASIKAPARSRL

SEQ ID NO: 6169 - protein, 162 aa, Chelidonium majus
MSISSTQKQDGLHKGVGLPALDISLAFPQATPASIFPPSASDYYQFDDLLTPEEQALRRKVREIMEKKIAPEVTEYWEKAEFPFHIIPNLATLRVAGSTIKGYGCPELSITGSAVATAEVARVDASCSTFILVHSSLAMLTIGLLGSDEQNKNIYPLWPICA

SEQ ID NO: 6170 - protein, 439 aa, Manihot esculenta
MTVDASKNRDDHDESVKSSYFNLPPLDVSIAFPQATPASIFPPCASDYYHFDDLLTPEEQAIRMKVRQCMEKEVAPIMAEYWEKAKFPFHIIPKLGALHIAGGTIKGYGCPGLSLTASAVATAEVARVDASCSTFILVHSSLAMITIALCGSEVQKQKYLPSLAQLSTVACWALTEPDYGSDASSLKTTATKVEGGWILEGQKRWIGNSTFADVLVIFARNTSTNQINGYIVKKDALGLTATKIENKIGLRIVQNGDIQLRKVFVPDEDRLPGVNSFQDTNKVLAVSRVMVAWQPIGISMGVYDICHRYLKERKQFGAPLAAFQINQQKLVHMLGNVQAMLLVGWRLCKLYEKGKMTPGRASMAKAWITLRARETVAIGRELLGGNGILADFLVAKAFCDLEPIYTYEGTYDINSLVTGREVTGLPSFKPAAVSQRSRL

SEQ ID NO: 6171 - protein, 440 aa, Ricinus communis
MTIYASSKNQDDLDHSQKSSYFNLPPLNVSIAFPQATPASIFPPCASDYFQLDDLLTPEEQAIRIKVRQCMEKEIAPIMTEYWEKAKFPFHVIPKLGTLRIAGGTIKGYGCPGLSLTGSAVATAEVARVDASCSTFILVHSSLAMLTIALCGSEAQKQKYLPSLAQLSTVACWALTEPEYGSDASALKTTARKVEGGWILDGQKRWIGNSTFADVLVVFARNTSTEQINGYIVKKDAPGLTATKIENKIGLRMVQNGDILLKQVFIPDEDRLPGVNSFQDTNKVLAVSRVMVAWQPIGISMGIYDMCHRYLKERKQFGAPLAAFQINQQKLVQMLGNVQAMVLVGWRLCKLYETGKMTSGHASMAKAWITSKARETAATGRELLGGNGILADFLVAKAFCDLEPIYTYEGTYDINTLVTGREVTGIASFKPAALSNRSRL

SEQ ID NO: 6172 - protein, 440 aa, Raphanus sativus
MTVLSSSTAREDAEKKVKSSYLDLPAMDVSVAFPQATPASKFPPCTSDYYHFDELLTPEEQAVRKKVREFMEKEVAPIMTEYWEKAEFPFHIIPKLGALGVVGGSIKGYGCPGLSITANAIATAEISRVDASCGTFNLVHTSLGMLTIALCGSEAQKQNYLPSLAQMKTVTCWALTEPDNGSDASALQTTATKVEGGWVLTGQKRWIGNSTFADLLIILARNTTTNQVNGFIVKKDAPGLTVTKIPNKIGLRIVQNGDILLQNVFVPDEERLPGVNSFQDTSKVLAVSRVMVAWQPIGISMGVYDMCHRYLMERKQFGAQLAAFQINQQKLVKMLGNVQAMFLMGWRLCKLYETGQMTPGQASLGKAWISSKARETASLGRELLGGNGILGDFLVAKAFCDLEPIYTYEGTYDINTLVTAREVTGIASFKPAASRSRSRL

SEQ ID NO: 6173 - protein, 368 aa, Primula obconica
EKEVAPVMAEYWEKAKFPFHVVPKFGALGIAGGSIKGYGCPGLSITANAIATAEVARVDASCSTFILVHSSLAMSTIAIGGSEAQKQRYLPSMAQLKTIGCWGLTEPDYGSDASALRTTATKVAGGWLLDGQKRWIGNSTFADVLVIFARNITTNELHAFLVKKDSPGLQATKIENKIGLRIVQNGDILMKQVFVPEEDRLPGVTSFQDINKVLGPSRLMVAWQPIGISMGVYDMCHRYLKERKQFGAPLAAFQISQQKLVQMLGNIQAMLLVGWRLCKLYEKDEMTVGKVSLGKAWISSKARETVSLGRELLGGNGILTDFLVAKAFCDLEPIYTYEGTYDINTLVAGREVTGIPSFKPAFTSRSRL

SEQ ID NO: 6174 - protein, 198 aa, Ipomoea nil
MENKIGLRIVQNGDILLNKVFVPDEDRLPGVNSFQDTSKVLAVSRVMVAWQPIGISMGVYDVCHRYLKERKQFGAPLAAFQINQQKLVQMLSNIQAMLLVGWRLCKLYESGKMTPGHASMGKSWITLKARETVSLGRELLGGNGILTDFLVAKAFCDLEPIYTYEGTYDINTLVTGREITGIASFKPPAAALSKRSRL

SEQ ID NO: 6175 - protein, 440 aa, Cynara scolymus
  misc_feature (12)..(12): Xaa can be any naturally occurring amino acid
MAIQSSKPQDDXSKDSKSSYFNFPALDVSVAFPQATPASVFPPCTSDFYHFDDLLTPAEQALRLRVRECVEREVAPIMTKYWEKAEFPFQIVPKLGALNIAGGTIKGYGCPGLSVTANAIVTAELARVDASCSTFILVHSSLGMLTISLCGSEIQKQKYLPSLAKLDTIACWGLTEPDYGSDASGLRTTATKVDGGWVLEGQKRWIGNSTFADILIIFAKNKDTNQINGFIVKKNAPGLQATKIENKIGLRMVQNGDILLQKVFVPDEDRLPGVNSFQDTSKVLAVSRVMVAWQPIGITMGVYDMCHRYLLERKQFGAPLAAFQINQQKLVQMLSNIQAMFLMGWRLCKLYEAGKMTPGQASLGKSWISLRARETVALGRELLGGNGILSDFLVAKAFGDLEPIYTYEGTYDINTLVTGREITGIASFKPVVKKPSMSRL

SEQ ID NO: 6176 - protein, 439 aa, Solanum lycopersicum
MKVPPTKTQEEMYKEAKSSYFDLPALDVSVAFPQATPASVFPNCTSDYYQLDDLLTSEEKAVRLKVRECMEKEIAPIMTKYWEKAEFPFEVIPKLGALNISGGTIKGYGCPGLSVTGSAIALAEIARVDASCCTFILVHSSLAMLTIGLLGSEMQRQKYLPSLADLSSISCWGLTEPDYGSDASALRTTATKVEGGWILEGQKRWIGNSTFADVLVIFARNAATNQINGFIVQKDAPGLQCTKIENKIGLRMVQNGDILFKKVFVPDEDRLPGVNSFNDTSKVLAVSRVMVAWLPIGIAMGVYDMCHRYLKERKQFGAPLAAFQLNQQKLVQMLSNIQAMLLVGWRLCKLYESGKMTPGQASLGKSWNTLRARETVSLGRELLGGNGILTDFLVAKAFCDLEPIYTFEGTYDINTLVTGREITGLPSFKPAPLRPQSRL

SEQ ID NO: 6177 - protein, 239 aa, Cucumis melo
MTVDAKVNRQDDKDKNARSAYFGLPALDVSVAFPQATSASSFPPSVSDFYQFNDLLTPEEQALRKKVRQCVEKEVAPIMTKYWEKAEFPFEVVPKLGSLCIAGGTIKGYGCPGLSITGSAVAVAEVARVDASCSTFILVHSSLAMLTIALCGSEEQKHKYLPSLAKFDTVACWALTEPENGSDASGLRTTATKVEGGWVIEGKKRWIGNSTFADVLVIFARNTITNEINGFIIKKMPLV

SEQ ID NO: 6178 - protein, 436 aa, Populus trichocarpa
MSIPKNKDEVEQNPRSSYFNLPPLDVSVAFPQATPVSTFPPSVSDYYQFSDLLTVEDQALRMRVRECMEKEIAPMMTEYWEKAKFPFHAIPKLGALGIAGGTIKGYGCPGLSITASAIAMAEVARVDASCSTFILVHSLAMLTIAFCGSEEQKLKYLPSLAQFSTVACWALTEPDYGSDASGLKTTAIKVEGGWILEGKKRWIGNSTFADLLVVFARNTTTNQINGFIVKKDAPGLTVTKIENKIGLRIVQNGDIVMKRVFVPDEDRLPGVNSFQDTNKVLAVSRIMVAWQPIGISMGVYDMCHRYLKERKQFGAPLAAFQINQQKLVHMLGNVQAMVLVGWRLCKLYEKEKMTPGQASLAKAWISLKARETASIGRELLGGNGILADFLVAKALCDLEPIYTYEGTYDINSLITGREITGLASFKPAMLSKRSRM

SEQ ID NO: 6179 - protein, 439 aa, Solanum lycopersicum
MKVPPTKTQEEMYKEAKSSYFDLPALDVSVAFPQATPASVFPKCTSDYYQLDDLLTSEEKAVRLKVRECMEKEIAPIMTKYWEKAEFPFEVIPKLGALNISGGTIKGYGCPGLSVTGSAIALAEIARVDASCCTFILVHSSLAMLTIGLLGSEMQRQKYLPSLADLSSISCWGLTEPDYGSDASALRTTATKVEGGWILEGQKRWIGNSTFADVLVIFARNAATNQINGFIVQKDAPGLQCTKIENKIGLRMVQNGDILFKKVFVPDEDRLPGVNSFNDTSKVLAVSRVMVAWLPIGIAMGVYDMCHRYLKERKQFGAPLAAFQLNQQKLVQMLSNIQAMLLVGWRLCKLYESGKMTPGQASLGKSWNTLRARETVSLGRELLGGNGILTDFLVAKAFCDLEPIYTFEGTYDINTLVTGREITGLPSFKPAPLRPQSRL

SEQ ID NO: 6180 - protein, 400 aa, Tragopogon dubius
FPPCTSDYYHFADLLTPEEQALRLRVRECVEKEVAPIMTKYWEKAEFPFQIIPKLGALNVAGGTIKGYGCPGLSVTANALVTAEIARVDASCSTFILVHSSLAMLTISLCGSEIQKQKYLPSLAKLDTIACWGLTEPDYGSDASGLRTTATKVEGGWVIEGQKRWIGNSTFADILVIFAKNKDTNQINGFIVKKNAPGLQATKIENKIGLRMVQNGDILLQKVFVPDEDRLPGVNSFQDTSKVLAVSRVMVAWQPIGITMGVYDMCHRYLQERKQFGAPLAAFQINQQKLVQMLANIQAMFLIGWRLCKLYESGKMTPGQASLGKSWITLRARETVALGRELLGGNGIISDFLVAKAFGDLEPIYTYEGTYDINTLVTGREITGIASFKPVGKKPQMSRL

SEQ ID NO: 6181 - protein, 179 aa, Triphysaria pusilla
KSVFVPDEDRLPGVNSFQDTNKVLAVSRVMVAWQPIGITMGVYDMCHRYLKERKQFGAPLAAFQINQQKLVRMLGNVQAMLLVGWRLCKLYEAGKMTPGHASLGKSWISAKARETVSLGRELLGGNGILADFLVAKAFCDLEPIYTYEGTYDINTLVTGREVTGIASFRPAAPNNRSRL

SEQ ID NO: 6182 - protein, 439 aa, Eucalyptus grandis
MTVRASPKPDNLEKEERSSYFGLPGLDVSVGFPQATPASVFPPCTSDYYHFDDLLTPEEQAIRKRVKECMEKEVAPIMAKYWEKAEFPFHIIPKLGALGIAGGTIKGYGCPGLSITGSAISTAEVARVDASFSTFILVHSSLAMLTISLCGSEEQKQKYLPSLAKLDTVACWALTEPDYGSDASALKTSATKVEGGWILEGQKRWIGNSTFADLLVIFARNSSTNQINGYIVKKNAPGLTARKMENKIGLRIVQNGDIILKKVFVPDNDRLPGVNSFQDTNKVLAVSRVMVAWQPIGLSMGVYDICHRYLKERKQFGAPLAAFQINQQKLVQMLGNVQAMFLVGWRLCKLYESGTMTPGHASLGKAWITARARETVALGRELLGGNGILSDFLVAKAFCDLEPIYTFEGTYDINNLVTGREVTGLASFKPAASSQRSRL

SEQ ID NO: 6183 - protein, 370 aa, Euonymus alatus
MEKEVAPVMAEYWEKAKFPFHVIPKLGALDIAGGTIKGYGCPGLSATAYSVAVAEVARVDASCSTFILVHSSLAMLTIALCGSEVQKQKYLPSLAQLQTVACWALTEPDYGSDASSLETTATKVEGGWMLEGQKRWIGNSTFADVLVIFARNITTNQINGFLVQKDAPGLTARKMENKIGLRIVQNGDILLKKVYVTDEDRLPGVNSFQDTSKVLAASRLAVCWQPIGISMGVYDMCHRYLKERKQFGAPLAAFQINQQKLVQMLGNIQAMILIGWRLCKLYEDSKMTPGQVSLAKSWISLKARETVALGRELLGGNGILADFLVGKAFCDLEPIYTYEGTYDINTLVTGREITGFASFKPAALGNRSRL

SEQ ID NO: 6184 - protein, 439 aa, Tripterygium wilfordii
MNRRSSENKDDIGKGQKSSYFNLPPLDVSIAFPQATPASIFPPCASDYYQFDDLLTPEEQSIRMKVRECMEKEVAPVMAEYWEKAKFPFHVIPKLGALDVAGGTIKGYGCPGLSMTAYAVAVAEIARVDASCSTFILVHSSLAMLTIALCGSEVQKQKYLPSLAQLQTVACWALTEPDYGSDASSLETTATKVEGGWILEGQKRWIGNSTFADVLVIFARNTTTNQINGFLVKKDAPGLTATKIENKIGLRIVQNGDILLKKVSVTDEDRLPGVNSFQDTNKVLAASRLMVAWQPIGISMGVYDMCHRYLKERKQFGAPLAAFQISQQKLVQMLGNIQAMILIGWRLCKLYEDGKMTAGHVSLAKSWITLKARETVALGRELLGGNGILTDFLVAKAFCDLEPIYTYEGTYDINTLVTGREISGLASFKPAALGKRSRL

SEQ ID NO: 6185 - protein, 440 aa, Cucumis sativus
MTIDAKMNRQDDKDKNARSSYFGLPALDVSVAFPQATSASSFPPSVSDFYQFNDLLTPEEQALRKKVRQCVEKEVAPIMTKYWEKAEFPFELVPKLANLGVAGGTIKGYGCPGLTITGSAIAVAEVARVDASCSTFILVHSSLAMLTIALCGSEEQKQKYLPSLAKFDTVACWGLTEPENGSDASGLRTTATKVEGGWVIEGRKRWIGNSTFADILVIFARNTITNEINGFIIKKNAPGLTVTKIENKIGLRMVQNGDIVMNKVFVPDEDRLVGVNSFKDTNKVLAVSRVMVAWQPIGIAMGVYDMCHRYLKEREQFGAPLAAFQLNQQKLVLMLGNVQAMFLIGWRLCKLYEKGTMTPGQASLGKSWITLRARETVALGRELLGGNGILSDFLVAKAFCDLEPIYTYEGTYDINTLVTGREITGVASFKPAALAKRSRL

SEQ ID NO: 6186 - protein, 440 aa, Tropaeolum majus
MTLPGSSTKQDNSDNKDRSSYFNLPALDIYAAFPQATPASKFPPSVSDYYKFDDLLTPEEQALRIKVRECMEKEVAPIMTEYWEKAEFPFHIVPKLGALRIAGGTIKGYGCPGLSITGSAIATAEVARVDASCSTFILVHSSLAMLTIALCGSESQKQKYLPSLAQLSDVACWALTEPDYGSDASGLRTIATKVEGGWLLEGQKRWIGNSTFADILIIFARNTSTNQINGFIVKKDAPGLTATKIQNKIGLRIVQNGDILLKKVFVPDEDRLPGVNSFQDTNKVLAVSRVMVAWQPIGISMGIYDMCHRYLKQRKQFGAPLAAFQINQQKLVTMLGNVQAMVLVGWRLCKLYEKGQMTTGQASLGKAWISSKARETAALGRELLGGNGILSDFLVAKAFCDLEPIYTYEGTFDINTLVTGREVTGLASFKPATSSQRSRL

SEQ ID NO: 6187 - protein, 428 aa, Solanum phureja
MHKEAKSSYFDMPALDVSVAFPQATPASNFPPCTSDYYQLADLLTPEEQAIRMKVREYMEKEIAPIMTKYWEKAEFPFEIIPKFGALHIAGGTIKGYGCPGHSITGSAVAAAEVARVDASCSTFLLVHSSLAMLTIGLCGSEMQKEKYLPSLAEFDTIACWGLTEPDYGSDASGLGTTAKKVEGGWILEGQKRWIGNSTFADILVIFARNTSTNQINGFIVKKDAPGLQCTKIENKIGLRIVQNGDILLKNVFVPDEDRLPGVNSFQDTNKVLAVSRVMVAWQPIGITMGVYDMCHRYLKERKQFGAPLAAFQINQQKLVQMLSNIQAMILVGWRLCKLHESDKLTHGHASLGKSWITLRARETVALGRELLGGNGILADFHVAKAFCDLEPIYTFEGTYDINTLVTGREITGLASFKPAPVRQKSRL

SEQ ID NO: 6188 - protein, 428 aa, Solanum lycopersicum
MHKEAKSSYFDMPALDVSVAFPQATPASNFPPCTSDYYQLADLLTPEEQAIRMKVRECMEKEIAPIMTKYWEKAEFPFEIIPKFGALHIAGGTIKGYGCPGHSITGSAVAAAEVARVDASCSTFLLVHSSLAMLTIGLCGSEMQKEKYLPSLAEFDTVACWGLTEPDYGSDASGLGTTARKVEGGWILEGQKRWIGNSTFADILVIFARNTSTNQINGFIVKKDAPGLQCTKIENKIGLRIVQNGDILLKNVFVPDEDRLPGVNSFQDTNKVLAVSRVMVAWQPIGITMGVYDMCHRYLKERKQFGAPLAAFQINQQKLVQMLSNIQAMILVGWRLCKLHESDKLTHGHASLGKSWITLRARETVALGRELLGGNGILADFHVAKAFCDLEPIYTFEGTYDINTLVTGREITGLASFKPAPVRQKSRL

SEQ ID NO: 6189 - protein, 153 aa, Triticum aestivum
MSRIMVAWQPIGISMGVYDMCHRYLKERKQFGAPLAAFQLNQEKLVRMLGNIQAMLLVGWRLCKLYESGKMTPGHASLGKAWTSSKSREVVSLGRELLGGNGILADFLVAKAFCDLEPIYSYEGTYDINSLVTGREITGIASFKPAAVAKSRL

SEQ ID NO: 6190 - protein, 440 aa, Cichorium intybus
MTIQSSKPQDDQNNNSKSSYSDFPALDVSLAFPQATPASIFPPCTSDYYHFADLLTPEEQALRLRVRACVEKEVAPIMTKYWEKAEFPFEIVPKLGALNIAGGTIKGYGCPGLSVTANALATAELARVDASCSTFILVHSSLAMLTISLCGSETQKQKYLPSLAKLDTIACWGLTEPDNGSDASGLTTTATKVQGGWVIEGQKRWIGNSTFADILVIFAKNKDTNQVNGFIVKKGAPGLRATKIENKIGLRMVQNGDILLQKVFVPDEDRLPGVNSFQDTSKVLAVSRVMVAWQPIGITMGVYDMCHRYLLERKQFGAPLAAFQINQQKLVQMLANIQAMFLIGWRLCKLYESGKMTPGQASLGKSWITLRARETVALGRELLGGNGIISDFLVAKAFGDLEPIYTYEGTYDINTLVTGREITGIASFKPVIRKPQMSRL

SEQ ID NO: 6191 - protein, 437 aa, Vigna unguiculata
MTIPSSTNPDGSVKNAMPSYFYLPPLDVSAAFPQATPASTFPPSASDYFQLDDLLTAEEHAIRRKVRECMEKEIAPIMTEYWEKAKFPFHVIPKLGALRIAGGTIKDYGCPGLSITGNAIATAEVARVDASCSTFILVHSSLAMLTIALCGSEAQKQKYLPSLAQFHTVACWALTEPDYGSDASALKTTATKVEGGWILEGQKRWIGNSTFADVLVVFARNAATNQINGFIIKKDAPGLTVTKIENKIGLRIVQNGDIVMRKVFVPDEDRIAGVNSFQDTNKVLAVSRIMVAWQPIGISMGIYDMCHRYLTERKQFGAPLAAFQISQQKLVQMLGNIQAMILVGWRLCKLYESGKMTPGHASLGKSWITLRARETAALGRELLGGNGILADFLVAKAFCDLEPIYTYEGTYDINTLITGREVTGVASFKPVAQRSRL

SEQ ID NO: 6192 - protein, 440 aa, Lactuca sativa
MTMQSSKPRDDQNNDSESSYSNFPPMDVSIAFPQATPASIFPPCTSDYYHFADLLTPEEQALRLRVRACVEKEIAPIMTKYWEKAEFPFEVVPKLGALNIAGGTIKGYGCPGFSVTANALATAEIARVDASCSTFILVHSSLAMLTISLCGSETQKQKYLPSLAKLDTIACWGLTEPDYGSDASGLRTTATKVEGGWVIEGQKRWIGNSTFADILVIFAKNKNTNQINGFILKKNSPGLKATKIENKIGLRMVQNGDILLQKVFVPDEDRLPGVNSFQDTSKVLAVSRVMVAWQPIGITMGVYDMCHRYLLERKQFGAPLAAFQINQQKLVQMLANIQAMFLIGWRLCKLYESGKMTPGQASLGKSWITLRARETVALGRELLGGNGIISDFLVAKAFGDLEPIYTYEGTYDINTLVTGREITGIASFKPVIKKPQISRL

SEQ ID NO: 6193 - protein, 369 aa, Cajanus cajan
MYGKRNCSNNDRVLGEGQVPIHVIPKLGALRIAGGTIKGYGCPGLSITGSAITMAEVARVDASCSTFILVHSSLAMLTIALCGSEAQKQKYLPSLAQLQTIACWGLTEPDYGSDASALKTTATKVDGGWILEGQKRWIGNSTFADVLVIFARNATTNQINGFIIKKDAPGLTVTKIENKIGLRIVQNGDIVMRKVFVPDEDRIAGVNSFQDTSKVLAVSRVMVAWQPIGISMGIYDMCHRYLKERKQFGAPLAAFQISQLKLVQMLGNIQAMILVGWRLCKLYESGKMTPGHASLGKSWITLRARETAALGRELLGGNGILADFLVAKAFCDLEPIYTYEGTYDINTLITGREVTDFASFKPVAQRSRL

SEQ ID NO: 6194 - protein, 437 aa, Glycine max
MAINSSKNPDGSVQNAMPSYFYSPPLDVSAAFPQATPASTFPPCASDYFQLDNLLTTEEQAIRKKVRECMEKEIAPIMTEYWEKAKFPFHVIPKLGALRIAGGTIKDYGCPGLSITGSAIAVAEVARVDASCSTFILVHSSLAMLTIALCGSEAQKQKYLPSLAQLQTVACWALTEPDYGSDASALKTTATKVEGGWILEGQKRWIGNSTFADVLVVFARNASTNQINGFIIKKDAPGLTVTKIENKIGLRIVQNGDIVMRKVFVPDEDRIAGVNSFQDTNKVLAVSRVMVAWQPIGISMGIYDMCHRYLKERKQFGAPLAAFQISQQKLVQMLGNIQAMILVGWRLCKLYESGKMTPGQASLGKSWITLRARETAALGRELLGGNGILADFLVAKAFCDLEPIYTYEGTYDINTLVTGREVTGFASFKPVAQRSRL

SEQ ID NO: 6195 - protein, 464 aa, Glycine max
MVSRPNLDNANMKMPSYFNFPALDVSVAFPQATPASTFPPCASDYFHFNDLLKPEEQAVRNRVRECMEKEIAPIMTEACLNPKSYLRERKEYYLDQRLVGLYSSCLKYWEKAEFPFHVIPKFAALRIAGGTIKGYGCPDLSIAGSAVAAAEVARVDASCSTFFLVHSSLAMLTIALCGSEAQKQKYLPSLAQMKTIACWALTEPDYGSDASALKTTATKVEGGWILDGQKRWIGNSTFADLLVIFARNMTTNQINGYIVKKDAPGLTVTKMENKIGLRIVQNGDIVMGKVFVPDDDRLEGVNSFQDTNKVLAVSRVMVAWQPIGLSMGIYDMCHRYLKERKQFGAPLAAFQISQQKLVQMLGNIQAMILVGWRLCKLYESGKMTPGHASLGKSWITLRARETAALGRELLGGNGILADFLVAKAFCDIEPIYTFEGTYDINTLVTGREITGFASFKPVAQKSRL

SEQ ID NO: 6196 - protein, 434 aa, Glycine max
MVSRPNLDNANMKMPSYFDLPPLDVSLAFPQATPASTFPPCASDYFQFDDLLKPEEQAIRMKVRECMEKNIAPIMTQYWEKAEFPFHVIPKFAALRIAGGTIKGYGCPDLSIAGSAVAAAEVARVDASCSTFFLVHSSLAMLTIALCGSEAQKQKYLPSLAQMKTIACWALTEPDYGSDASALKTTATKVEGGWILDGQKRWIGNSTFADLLVIFARNMTTNQINGYIVKKDAPGLTVTKMENKIGLRIVQNGDIVMGKVFVPDDDRLEGVNSFQDTNKVLAVSRVMVAWQPIGLSMGIYDMCHRYLKERKQFGAPLAAFQISQQKLVQMLGNIQAMILVGWRLCKLYESGKMTPGHASLGKSWITLRARETAALGRELLGGNGILADFLVAKAFCDIEPIYTFEGTYDINTLVTGREITGFASFKPVAQKSRL

SEQ ID NO: 6197 - protein, 139 aa, Cucurbita pepo
ETVHGKEIAPIMTKYWEKAEFPFHVIPKLGNLCIAGGTIKGYECPGMTITGSAIATAEVARVDASCSTFILVHSSLAMLTIALCGSEEQKQKYLPSLAKLDTIACWALTEPENGSDASGLRTTATKVEGGWLIEGKNAG

SEQ ID NO: 6198 - protein, 439 aa, Euphorbia peplus
MAIHPPKTSDDIDESSRSSYFNSPPLDVSVAFPQATPASTFPPSASDYFQLDDLLTPEEQALRIKVRQCMEKKVAPIMAEYWEKAKFPFHVVPDLGALCIAGGTIKGYGCPGLSLTGSATAVAEVCRVDASCGTFIIVHSSLAMLTIAFCGSEAQKQKYLPSLAQLRTIACWGLTEPDYGSDASSLKTTARKVQGGWIIDGQKRWIGNSTFADVLVIFARNTSTNQINGYIVKKDSPGLTCTKIENKIGLRMVQNGDIVLKQVFVPDEDRLPGVNSFQDTSKVLAVSRVMVAWQPIGISMGIYDMCHRYLKERKQFGAPLAAFQINQQKLVHMLSNVQAMTLVGWRLCKLYESGKMTPGHASMAKSWITLRARETAAIGRELLGGNGILADFLVAKAFCDLEPIHTYEGTYEINALVTGREITGVASFKAAAKSKHSRL

SEQ ID NO: 6199 - protein, 215 aa, Zostera marina
NQINAFIVKKGSPGLEVSKIENKIGLRMVQNGDILLKKVFVPDEDRLSGINSFKDINKVLAVSRVMVAWQPIGITMGAYDMCHRYLRERKQFGAPLAAFQINQEKLVRMLGNIQAMVLVGWRICNIYESGKMTPGQASMAKAWISLRARETVSLAREMLGGNGILSDFLVAKAFCDLEPIYSYEGTYDINCMVTAREITGLSSIKPTIPGKRSRL

SEQ ID NO: 6200 - protein, 440 aa, Artemisia annua
MTSFQSSKPQDEQNKDSKSSYFDSPALDVSLAFPQATPASVFPPCTSDYYQFADLLTPEEQALRLKVRACVEKEIAPIMTKYWEKAEFPFEIVPKLGALNIAGGTIKGYGCPGLSVTANALVTAEIARVDASCSTFILVHSSLAMLTISLCGSEIQKQKYLPSLAKLDTIACWGLTEPDYGSDASGLRTTATKVDGGWVIEGQKRWIGNSTFADILVIFAKNKDTNQINGFILKKNAPGLQATKIENKIGLRMVQNGDILMQKVFVPDEDRLPGVNSFQDTSKVLAVSRVMVAWQPIGITMGVYDMCHRYLQERKQFGAPLAAFQINQQKLVQMLSNIQAMFLIGWRLCKLYESGKMTPGQASLGKSWITLRARETVALGRELLGGNGIISDFLVAKAFGDLEPIYTYEGTYDINTLVTGREITGIASFKPVVKPTRSRM

SEQ ID NO: 6201 - protein, 439 aa, Castanea mollissima
MTVFSSTKQDDRDQNPRTSYFNSPPLDISVAFPQATPASIFPPCKSDYYQLDDLLSPEEQTVRKKVRECMEKEIAPIMTQYWEKAKFPFHVIPKLGALRITGGTIKGYGCPGHSITGSAVATAEVARVDASCSTFILVHSSLAMLTIALCGSEAQKQKYLPSLAELKTVACWALTEPEYGSDASALKTIATKVEGGWILEGQKRWIGNSTFADLLVIFARNTTTNQINGFIVKKDAPGLTVSKIENKIGLRIVQNGDILLKKVFIPDEDRIPGVDSFQDTNKILAVSRVMVAWQPIGISMGIYDMCHRYLKERKQFGAPLAAFQINQLKLVQMLGNVQAMILVGWRLCKLYENGKMTPGQASLGKSWITLKARETAAIGRELLGGNGILADFLVAKAFCDLEPIYTYEGTYDINSLVTGREVTGIASFKPAVSSRRSRL

SEQ ID NO: 6202 - protein, 437 aa, Populus trichocarpa
MAIPKNQDEVEQNARSSYFNLPPLDVSVAFPQATPASTFPPSVSDYFQISDLLTAEDQAIRMRVRQCMEKEIAPIMAEYWEKAKFPFHVIPKLGALGIAGGTIKGYGCPGLSITTSAVAIAEVARVDASCSTFILVHSSLAMLTIALCGSEEQKQKYLPSLAKFSTVACWALTEPDYGSDASSLQTTATKVEGGWILEGQKRWIGNSTFADLLVIFARNTTTDQINGYIVKKDAPGLTVTKIENKIGLRIVQNGDIVMKRVFVPDEDRLPGVNSFQDTNKVLAVSRVMVAWQPIGISMGVYDMCHRYLKERKQFGAPLAAFQINQQKLVHMLGNVQAMVLVGWRLCKLYEKGTMTPGHASLAKSWISLKARETAAIGRELLGGNGILSDFLVAKAMGDLEPIYTYEGTYDINSLVTGREITGLASFKPAMLSKRSRL

SEQ ID NO: 6203 - protein, 439 aa, Raphanus sativus
  misc_feature (10)..(10): Xaa can be any naturally occurring amino acid
  misc_feature (21)..(21): Xaa can be any naturally occurring amino acid
MTVLSSADRXNGEKKVKSSYXDLPSMEISVAFPQATPASKFPPCTSDYYHFDDLLTPEEQAVRKRVREFMEKEVAPIMTQYWEKAEFPFHIIPKFGALGVAGGSIKGYGCPGLSITANAIATAEISRVDASCGTFNLVHTSLGMLTIALCGSEAQKQKYLPDLAQMKTVTCWALTEPDNGSDASALKTTATKVEGGWVLEGQKRWIGNSTFADLLVILARNTTTNQVNGFLVQKDAPGLTVTKIPNKIGLRIVQNGDILLQNVFVPDEERLPGVNSFQDTSKVLAVSRVMVAWQPIGISMGVYDMCHRYLKERKQFGAPLAAFQINQQKLVKMLGNVQAMFMMGWRLCKLYETGQMTPGQASLGKAWITSKARETASLGRELLGGNGVLGDFLVAKAFGDLEPIFTYEGTYDINTLVTGREVTGIASFKPPASRGRSRL

SEQ ID NO: 6204 - protein, 474 aa, Ceratodon purpureus
MERSVGSEVMEQKSQRRLARIHGHLEPAETDFSSQLESVPTLAIGLPPLDVRSAFPQATPASEFPPSVSDFFQLDDLLSSEDVALRERIRSVMEKHVAPVMTKYWEKAEFPFECLPHISSLMVAGGTTKGYGCPGLSVLSSALAMSEIARVDASCSTFVLVHSSLGMATIAMLGSEAQKHKYLPGLARFDLVGCWALTEPGYGSDASSLNTTAKKVEGGWLLNGQKRWIGNATFADIAVVFARNTQTNQINGFIVKKGSPGYRATKIENKIGLRMVQNGDITMNDVFVPDEDRLPGINSFKDTSKVLAVSRIMVAWQPIGIAMGVYDMCHRYLLERKQFGAPLAALQINQEKLVRMLGNIQAMFLLGWRLCKIYEAGKMTPGQASLCKSWNTKRARETVALGRELLGGNGILADFLVAKAFCDLEPIYTYEGTYEINALVTGREITGIASIKPSGGKPKTLSTSEGVVRNTTKN

SEQ ID NO: 6205 - protein, 440 aa, Centaurea maculosa
MTIHSSKPQDDQNKDSKSSYFNLPALDVSIAFPQATPASIFPPCTSDYYHFNDLLTPAEQALRLRVRECVEKDVAPIMTKYWEKAEFPFEIVPKLGALNIAGGTIKGYGCPGLSVTANAIVTAEIARVDASCSTFILVHSSLAMLTISLCGSELQKQKYLPSLAKLDTIACWGLTEPDYGSDASSVRTTATKVDGGWVLEGQKRWIGNSTFADILVIFAKNKETNQINGFIVKKNAPGLQATKIENKIGLRMVQNGDILLQKVFVPDEDRLPGVNSFQDTSKVLAVSRVMVAWQPIGITMGVYDMCHRYLLERKQFGAPLAAFQINQQRLVQMLSNIQAMFLMGWRLCKLYEAGKMTPGQASLGKSWITLRARETVALGRELLGGNGILSDFLVAKAFGDLEPIYTYEGTYDINTLVTGREITGIASFKPVIKKPQMSRL

SEQ ID NO: 6206 - protein, 412 aa, Cephalotaxus harringtonia
DAFPQATSASKFPPCVSDYYQLDDLLTPEEKSIRKKVREAVEAEIAPIIAKYWERAEFPFEVVPKLANLKLAGGTIKGYGCPGLSVVSSALSMAEIARVDASCSTFIMVHSCLAMLTISMCGNEHQKKKYLPSLAQLDTISCWALTEPSYGSDASSLSTTATKVEGGWKLDGQKRWIGNSTFADILVVFARNTTTNQINGFIVKKGTPGLKVTKIENKIGLRIVQNGDILMKGVFVPDEDRLTGINSFQDTNKVLAVSRIMVSWQPIGIAMGVYDMCHRYLQERKQFGASLSSFQINQEKLVRMLGNIQAMSLMGWRLCKLYESGKMTPGHASLAKAWNTLRARETVSLGRELLGGNGILSDFLVAKAFCDLEPIYSYEGTYDINALVTGREVTGTASFKAPPVSRGIRAKL

SEQ ID NO: 6207 - protein, 182 aa, Sciadopitys verticillata
MKGVFVPDEDKLTGINSFQDTSKVLAVSRIMVAWQPIGISMGVYDMCHRYLRERKQFGVSLSSFQINQEKLVRMLGNIQAMALMGWRLCKLYESGKMTPGHASLAKAWNTLRARETVSLGRELLGGNGILSDFLVAKAFGDLEPIYSYEGTYDVNVLVTGREVTGTASFKAPPVSRGIKAKL

SEQ ID NO: 6208 - protein, 110 aa, Thalictrum flavum
LQKVFVPDEDRLPGVNSFQDTSKVLAVSRVMVAWQPIGISMGVYDMCLRYLKERKQFGVPLAAFQINQEKLVRMLGNVQAMFLVGWRLCKLYESGKMTLAMLAWGRHGLP

SEQ ID NO: 6209 - protein, 439 aa, Unknown
  Sequence found in Organisms: Brassica napus, Brassica rapa
MTVLSSADRDNAEKKVKSSYFDLPPMEISAAFPQATPASKFPPCTSDYYNFNDLLTPEEQAVRKRVREFMEKEVAPIMTEYWEKAEFPFHIIPKFGALGVAGGSIKGYGCPGLSITANAIATAEISRVDASCGTFNLVHTSLGMLTIALCGSEAQKQKYLPDLAQMKTVTCWALTEPDNGSDASALTTTATKVEGGWVLEGQKRWIGNSTFADLLVILARNTTTNQVNGFLVQKDAPGLTVTKIPNKIGLRIVQNGDILLKNVFVPDEERLPGVNSFQDTSKVLAVSRVMVAWQPIGISMGVYDMCHRYLMERKQFGAPLAAFQLNQQKLVKMLGNVQAMFMMGWRLCKLYESGQMTPGQASLGKAWISSKARETASLGRELLGGNGVVGDFLVAKAFGDLEPIFTYEGTYDINTLVTGREVTGIASFKPPASRGRSRL

SEQ ID NO: 6210 - protein, 439 aa, Brassica napus
MTVLSSADRDNAEKKVKSSYFDLPAMEISVAFPQATPASKFPPCTSDYYHFDDLLTPEEQAVRKRVREFMEKEVAPIMTEYWEKAEFPFHIIPKFGALGVAGGSIKGYGCPGLSITANAIATAEISRVDASCGTFNLVHTSLGMLTIALCGSEAQKQKYLPDLAQMKTVTCWALTEPDNGSDASALTTTATKVEGGWVLEGQKRWIGNSTFADLLVIIARNTTTNQVNGFLVQKDAPGLTVTKIPNKIGLRIVQNGDILLKNVFVPDEERLPGVNSFQDTSKVLAVSRVMVAWQPIGISMGVYDMCHRYLMERKQFGAPLAAFQLNQQKLVKMLGNVQAMFMMGWRLCKLYESGQMTPGQASLGKAWISSKARETASLGRELLGGNGVVGDFLVAKAFGDLEPIFTYEGTYDINTLVTGREVTGIASFKPPASRGRSRL

SEQ ID NO: 6211 - protein, 150 aa, Solanum tuberosum
MVAWQPIGITMGVYDMCHRYLKERKQFGAPLAAFQINQQKLVQMLSNIQAMILVGWRLCKLHESDKLTHGHASLGKSWITLRARETVALGRELLGGNGILADFHVAKAFCDLEPIYTFEGTYDINTLVTGREITGLASFKPAPVRQKSRL

SEQ ID NO: 6212 - protein, 188 aa, Capsicum annuum
MVHNGDIFLKKVFVPDEDRLPGVNSFKDTNKVLAVSRVMVTWMPIGIAMGVYDMCHRYLKERMQFGAPLAAFQINQQKLVQMLSNIQAMLLVGWRLCKLYESGKMTPGQASLGKSWNTLRARETVSLGRELLGGNGILSDFLVAKAFCDLEPIYTFEGTYDINTLVTGREITGLPSFKPATLRPNSRL

SEQ ID NO: 6213 - protein, 433 aa, Medicago truncatula
MTRSNPQDKIGNMPSYFDLPPLDVSLAFPQATPASTFPPCASDYFQFDDLLKPEEQAIRMKVRECMEKNIAPIMTQYWEKAEFPFHAIPKLGELGIAGGTIKGYGCPGLSVTGSAIATAEVARVDASCSTFILVHSSLAMLTIALCGSEAQKQKYLPSLAQLKTIACWALTEPDYGSDASALKTTATKVEGGWILEGQKRWIGNSTFADLLVIFARNTSTNQINGYIVKKDAPGLTVTKIENKIGLRIVQNGDIVMRKVFVPDEDRIEGVNSFQDTNKVLAVSRVMVAWQPIGISMGIYDMCHRYLKERKQFGAPLAAFQINQQKLVQMLSNVQAMILVGWRLCKLYESGKMTPGHASLGKSWITLRARETAALGRELLGGNGILADFLVAKAFCDLEPIYTYEGTYEINTLVTGREVTGFASFKPATQRSRM

SEQ ID NO: 6214 - protein, 375 aa, Triticum aestivum
  misc_feature (102)..(102): Xaa can be any naturally occurring amino acid
MRIIPRDQNSGAFFIAVLQKLSPLNESLVVEVMKGERSTSKDKALKCSNGQGSDTVPAEEISVQQPGVDDTHVLVEQQNRDMDTEISKDKSSEEAKVVAGEXQNDQATRRDKRKTQNQGRWRGVDPVIFFKDEATIRSIVSFYGIKDSFTLEGHLVTRNPDTNHVKRIYYVSKSVKEVLDLNLKVGERLKITSLGLKIFERQSSKEGSPCTFRLSSEGLPLLLPYITKQILYASAIDFQHLLQYRIIKFPDFVDVKFGEQASALLQGCCVVILREGHEDLESIGMDPSAIAVVCWKGKTNLCVMVTPMDGRELLERISFRFGLKIPKLDDGKPDLKCDDGSDEQPDGGAETVDPDCVPESKASEDMDISDVKDTE

SEQ ID NO: 6215 - protein, 494 aa, Triticum aestivum
TFTVGGLSAINAVAGAFSENLPVICIVGGPNSNDYGSNRILHHTIGIPDFTQELRCFQNVTCYQAVVNNLEDAHEQIDTAISTALKESKPVYISISCNLPSIPHPTFSRHPVPFFLSPKLSNQMTLEAAVETAAAFLNKSVKPVLVGGPKMRVAKACEAFVELADACGYPVAVMPSAKGLVPEHHSRFIGTYWGAVSTPFCAEIVESADAYLFAGPIFNDYSSVGYSLLLKKEKAIIVQPDRVVIGNGPAFGCVLMKDFLHALATRLKKNTAAYDNYSRIFVPQGEPLSSEPGEPLRVNILFKHIQKMLSGSSAVIAETGDSWFNCQKLKLPEGCGYEFQMQYGSIGWSVGATLGYAQAAKDKRVISFIGDGSFQVTAQEVSTMLRWEQNNIIFLINNGGYTIEVEIHDGPYNIIKNWNYTGVVEAFHNGEGKCYTAKVRTEEELKKAIEASLGPNKDSLCFIEVIVHKDDTSKELLEWGSRVSAANSRPPNPQ

SEQ ID NO: 6216 - protein, 606 aa, Quercus alba
MDTKIGALDACPHSSTDLCAVPSNGAVSTIQSSTPSTIVTPSDATLGRHLARRLVQIGVTDVFSVPGDFNLTLLDHLIAEPGLTNVGCCNELNAGYAADGYARSRGVGACVVTFTVGGLSVLNAIAGACSENLPLICIVGGPNSNDYGTNRILHHTIGLPDFSQELRCFQTVTCYQAVVNNLEDAHELIDTAISTSLKESKPVYISISCNLAGVPHPTFSREPVPFSLSPRLSNQMGLEAAVEAAAGFLDKAVKPVLVGGPKLRVANATDAFVELADACGYPLAVMPSAKGLVPEHHPHFIGTYWGAISTPFCAEIVESADAYLFAGPIFNDYSSVGYSLLLKKEKAIIVQPDRVVIGNGPAFGCILMKDFLRALGKRLKRNTTAYENYHRIFVPDGLPLKSAPKEPLRVNVLFQHIQNMLSSETAVIAETGDSWFNCQKLKLPQGCGYEFQMQYGSIGWSVGATLGYAQAVPEKRVIACIGDGSFQVTAQDVSTMIRYGQRTIIFLINNGGYTIEVEIHDGPYNVIKNWNYTGLVDAIHNGEGKCWTTKVRCEEELIEAINTATGDKKDSLCFIEVIVHKDDTSKELLEWGSRVSAANSRPPNPQ

SEQ ID NO: 6217 - protein, 424 aa, Hordeum vulgare
EDAHEQIDTAISTALKESKPVYISISCNLPSIPHPTFSRHPVPFFLSPKLSNQMNLEAAVETAAAFLNKSVKPVLVGGPKMRVAKACEAFVELADACGYPVAVMPSAKGLVPEHHSRFIGTYWGAVSTPFCAEIVESADAYLFAGPIFNDYSSVGYSLLLKKEKAIIVQPDRVVIGNGPAFGCVLMKDFLHALATRLKKNTAAYDNYSRIFVPQGEPLSSEHGEPLRVNVLFKHIQKMLSGSSAVIAETGDSWFNCQKLKLPEGCGYEFQMQYGSIGWSVGATLGYAQAAKDKRVISFIGDGSFQVTAQEVSTMLRWGQNNIIFLINNGGYTIEVEIHDGPYNIIKNWNYTGVVEAFHNGEGKCYTAKVRTEEELKKAIEASLGPNKDSLCFIEVIVHKDDTSKELLEWGSRVSAANSRPPNPQ

SEQ ID NO: 6218 - protein, 606 aa, Lotus japonicus
MDVKLGSLDTTKPASNDVVSCATANHTTAIQSSIPSTAVSTCDATLGRHLARRLAQIGVTDVFSVPGDFNLTLLDHLIAEPQLNLVGCCNELNAGYAADGYARARGVGACVVTFTVGGLSVLNAIAGAYSENLPLICIVGGPNSNDYGTSRILHHTIGLPDFTQELRCFQTVTCFQAVVNNLEDAHEQIDTAISTALKESKPVYISISCNLPGIPHPTFSRDPVPFSLSAKLSNQMGLEAAVEATAEFLNKAVKPVLVGGPKLRVAKASDAFVELADASGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKALAKRLKHNNAAYENYHRIFVPEGKPLKSAPKEPLRVNVMFQHIQKMLSGETAVIAETGDSWFNCQKLKLPRGCGYEFQMQYGSIGWSVGATLGYAQAVPEKRVIACIGDGSFQVTAQDVSTMLRCGQNTIIFLINNGGYTIEVEIHDGPYNVIKNWNYTGLIEAIHNGEGKCWTSKVFCEEELVEAIATATGPKKDCLCFIEVIVHKDDTSKELLEWGSRVSAANGRPPNPQ

SEQ ID NO: 6219 - protein, 607 aa, Ricinus communis
MDTNIGSIDTLKPTTTDVCCPANGAVCTLQSSTVSPSSIVSSPDSTLGRHLARRLVQVGVTDVFSVPGDFNLTLLDHLIAEPGLNVIGCCNELNAGYAADGYARSRGVGACVVTFTVGGLSVLNAIAGAYSENLPVVCIVGGPNSNDYGTNRILHHTIGLPDFSQELRCFQPVTCFQAIVNNLEDAHELIDTAISTALKESKPVYLSISCNLSAIPHPTFSREPVPFSLSPRLSNKIGLEAAVEAAAEFLNKAVKPVLVGGPKLRVAKACEAFVELADACGYALAVMPSAKGLVPEHHSHFIGTYWGAVSTAFCAEIVESADAYLFAGPIFNDYSSVGYSLLLKKEKSIIVQPDRVVIGNGPAFGCVLMKDFLKALAKRLKNNTTAHENYRRIFVPEGQPLKSQPKEPLRVNVLFQHIQKMLSSETAVIAETGDSWFNCQKLKLPKGCGYEFQMQYGSIGWSVGATLGYAQAVPEKRVIACIGDGSFQVTAQDVSTMLRCGQKTIIFLINNGGYTIEVEIHDGPYNVIKNWNYTGLVDAIHNGEGKCWTAKVQCEEELIEAIETATESKKDCLCFIEVIAHKDDTSKELLEWGSRVSAANSRPPNPQ

SEQ ID NO: 6220 - protein, 444 aa, Citrus sinensis
MDTKIGSLDTCKPPCSDLASPPNGAVSTIQSSVPATPLVNPSESTLGRHLARRLVQIGATDVFSVPGDFNLTLLDHLIAEPGLNLIGCCNELNAGYAADGYARSRGVGACVVTFTVGGLSVLNAIAGAYSENLPLICIVGGPNSNDYGTNRILHHTIGLPDFSQELRCFQTVTCYQAVVNNLEDAHELIDTAVSTALKESKPVYISVACNLPAIPHPTFSREPVPFSLSPKLSNEMGLEAAVEAAAEFLNKAVKPVLVAGPKMRVAKACNAFVELADACGYAVAVMPSAKGLVPEHHPHFIGTYWGAVSTAFCAEIVESADAYLFAGPIFNDYSSVGYSLLLKKEKAVILQPDRVVIANGPAFGCVLMKDFLKALSKRLKSNTTAYENYHRIYVPEGQPPKCEPKEPLRVNVLFQHIQKMLSSETAVIAETGDSWFNCQKLKIA

SEQ ID NO: 6221 - protein, 518 aa, Carica papaya
CNELNAGYAADGFARSRGVGACVVTFTVGGLSVLNAIAGAYSENLPVICIVGGPNSNDYGTNRILHHTIGLPDFSQELRAFQTVTCYQAVVNNLEDAHEQIDTAVSTALKESKPVYISISCNLPAIPHPTFVREPVPFFLSPRLSNHLGLEAAVEATAEFLNKAVKPVLVGGPKLRVAKAGDAFVELADASGYAVAVMPSAKGLVPEHHPHFIGTYWGAVSTAFCAEIVESADAYLFAGPIFNDYSSVGYSLLLKKEKAIIVQPDRVVVANGPAFGCVLMKDFLKALAKRLKKNDTAYENYHRIFVPEGQPVKGDPVEPLRVNVLFQHIQNMLSGDSAVIAETGDSWFNCQKLKLPKGCGYEFQMQYGSIGWSVGATLGYAQAVPEKRVIACIGDGSFQVTAQDVSTMIRCGQKSIIFLINNGGYTIEVEIHDGPYNVIKNWNYTALVDAIHNGEGKCWTAKVRCEKELIEAISAATGPKKDCLCFIEVIVHKDDTSKELLEWGSRVSAANSRPPNPQ

SEQ ID NO: 6222 - protein, 606 aa, Unknown
  Sequence found in Organisms: Citrus clementina, Citrus sinensis
MDTKIGSLDTCKPPCSDLASPPNGAVSTIQSSVPATPLVNPSESTLGRHLARRLVQIGATDVFSVPGDFNLTLLDHLIAEPGLNLIGCCNELNAGYAADGYARSRGVGACVVTFTVGGLSVLNAIAGAYSENLPLICIVGGPNSNDYGTNRILHHTIGLPDFSQELRCFQTVTCYQAVVNNLEDAHELIDTAVSTALKESKPVYISVACNLPAIPHPTFSREPVPFSLSPKLSNEMGLEAAVEAAAEFLNKAVKPVLVAGPKMRVAKACNAFVELADACGYAVAVMPSAKGLVPEHHPHFIGTYWGAVSTAFCAEIVESADAYLFAGPIFNDYSSVGYSLLLKKEKAVILQPDRVVIANGPAFGCVLMKDFLKALSKRLKSNTTAYENYHRIYVPEGQPPKCEPKEPLRVNVLFQHIQKMLSSETAVIAETGDSWFNCQKLKLPKGCGYEFQMQYGSIGWSVGATLGYAQSVPEKRVIACIGDGSFQVTAQDVSTMLRCGQKTIIFLINNGGYTIEVEIHDGPYNVIKNWNYTGLVDAIHNGEGKCWTTKVFCEEELIEAIENATGPKKDCLCFIEVLVHKDDTSKELLEWGSRVSAANSRPPNPQ

SEQ ID NO: 6223 - protein, 605 aa, Euonymus alatus
MDTKVGSIDTSKAESSNVGCPSNVGVSAVQDSVNTIFGHSSESTLGRHLARRLVQVGVTDVFSVPGDFNLALLDHLVAEPGLNLIGCCNELNAGYAADGYARSRGVGACVVTFTVGGLSVLNAIAGAYSENLPLICIVGGPNSNDYGTNRILHHTIGLPDFSQELRCFQNLTCYQAMVNNLEDAHELIDTAISTALKESKPVYISISCNLPAIPHPTFTREPVPFSLSPKLSNQMGLEAAVEEAAAFLNKAVKPVLVAGPKLRSAKACDAFVELADACGYSLAVMPSAKGLVPEHHPHFIGTYWGAVSTAFCAEIVESADAYLFAGPIFNDYSSVGYSLLLKKEKAIIVQPDRVTIANGPAFGCILMKDFLKALAKRLKRNTTAYENYHRIYVPDGHPLQSAPKEPLRVNVLFEHIQKMLSHETAVIAETGDSWFNCQKLKLPNGCGYEFQMQYGSIGWSVGATLGYAQAVPEKRVIACIGDGSFQVTAQDISTMLRCEQRSIIFLINNGGYTIEVEIHDGPYNVIKNWNYTGLVDAIHNGEGKCWTTKVLCEEDLIEAIETATGPKKDCLCFIEVIAHKDDTSKELLEWGSRVSAANSRPPNPQ

SEQ ID NO: 6224 - protein, 607 aa, Glycine max
MDTRIGSLDAAKPACNDVVSCNHTTSAAIQPCVPATVINGAGGDSTLGGHLARRLVEIGVTDVFSVPGDFNLTLLDHLIAEPALNLVGCCNELNAGYAADGYARARGVGACVVTFTVGGLSVLNAIAGAYSENLPLICIVGGPNSNDYGTSRILHHTIGLPDFSQELRCFQTITCFQAVVNNLEDAHELIDTAISTALKESKPVYISISCNLPGIPHPTFSRDPVPFSLSPRLSNKMGLEAAVEAAAEFLNKAVKPVLVGGPKLRVATASDAFVELADACGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKALAKRLKHNNTAYENYHRIFVPEGHPLKATPREPLRVNVLFQHIQKMLSGETAVIAETGDSWFNCQKLKLPKGCGYEFQMQYGSIGWSVGATLGYAQAVPEKRVIACIGDGSFQVTAQDVSTMLRCGQKTIIFLVNNGGYTIEVEIHDGPYNVIKNWNYTGLIDAIHNGEGKCWTAKVFCEEELVEAIATATGHKRDSLCFIEVIVHKDDTSKELLEWGSRVSAANSRPPNPQ

SEQ ID NO: 6225 - protein, 608 aa, Glycine max
MDTKIGSLDAPKPNSNDVVSCNLTSSAAIQPCLPATVINGAGCSDSTLGGHLARRLVEIGVTDVFSVPGDFNLTLLDHLIAEPALHLVGCCNELNAGYAADGYARARGVGACVVTFTVGGLSVLNAIAGAYSENLPLICIVGGPNSNDYGTSRILHHTIGLPDFSQELRCFQTITCFQAVVNNLEDAHELIDTAISTALKESKPVYISISCNLPGIPHPTFSRDPVRFSLSPRLSNKMGLEAAVEAAAEFLNKAVKPVLVGGPKLRVATASDAFVELADACGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKALAKRLKHNNTAYENYHRIFVPDGHPLKAAPREPLRVNVLFQHIQNMLSGETAVIAETGDSWFNCQKLKLPKACGYEFQMQYGSIGWSVGATLGYAQAVPEKRVIACIGDGSFQVTAQDVSTMLRCGQKTIIFLINNGGYTIEVEIHDGPYNVIKNWNYTGLIDAIHNGEGKCWTAKVFCEEELVEAIATATGPKKDSLCFIEVIVHKDDTSKELLEWGSRVSAANSRPPNPQ

SEQ ID NO: 6226 - protein, 606 aa, Vigna unguiculata
  misc_feature (172)..(172): Xaa can be any naturally occurring amino acid
MDTKIGSLDVVKPPCNDIVSCNQTNSAAIQPCVPSAVINGCGDSTLGGHLARRLVEVGVTDVFSVPGDFNLTLLDHLIAEPALNVVGCCNELNAGYAADGYARARGVGACVVTFTVGGLSVLNAIAGAYSENLPLICVVGGPNSNDYGTSRILHHTIGLPDFSQELRCFQTXTCFQAVVNNLEDAHELIDTAISTALKESKPVYISISCNLPGIPHPTFSRDPVPFSLSPRLSNKLGLEAAVEAAAEFLNKAVKPVLVGGPKLRVATAGEAFVELADACGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKGLAKRLKHNNTAYENYHRIFVPEGHPLKAAPKEPLRVNVLFQHIQNMLSGETAVIAETGDSWFNCQKLKLPKGCGYEFQMQYGSIGWSVGATLGYAQAVPEKRVIAFIGDGSFQVTAQDVSTMLRSGQKTIIFLINNGGYTIEVEIHDGPYNVIKNWNYTGLVDAIHNGQGKCWTAKVFCEEELVEAIATATGPKKDSLCFIEVIVHKDDTSKELLEWGSRVSAANSRPPNPQ

SEQ ID NO: 6227 - protein, 603 aa, Ipomoea batatas
MDTKIGSIEACKPGSGDVANAPTNGVNTVHSTPVAFSSAEATLGRHLARRLVQIGVTDVFSVPGDFNLTLLDHLIAEPRLNLIGCCNELNAGYAADGYARARGVGACVVTFTVGGLSVLNAIAGAYSENLPLICIVGGPNSNDYGTNRILHHTIGLPDFSQELRCFQTVTCYQAVVNNLEDAHELIDTAVSTAVKESKPVYISIGCNLAGIPHPTFIREPVPFSLNPKLSNQMGLEAAVEAAAEFLNKAVKPVLVGGPKMRVAKACKAFVELADSCGYATAVMPSAKGLVPEHHPHFIGTYWGAVSTAFCAEIVESADACLFAGPIFNDYSSVGYSLLLKKEKAVIVQPDRVTIANGPAFGCVLMKDFLSALAKRLKHNKTAYENYSRIFVPEGQPLECEPKEPLRVNVLFQHIQKMLSGETAVIAETGDSWFNCQKLKLPQGCGYEFQMQYGSIGWSVGATLGYAQATPERRVISCIGDGSFQVTAQDVSTMLRCGQRPIIFLINNGGYTIEVEIHDGPYNVIKNWNYTALIDAIHNGEGKCWTAKVFYEEELIEAIETATGAKKDCLCFIEVIVHKDDTSKELLEWGSRVSAANSRPPNPQ

SEQ ID NO: 6228 - protein, 603 aa, Aquilegia formosa
METKILLDSNNPTTHDVGCLPHNGTVSTVQNSVVPIGSVESTLGRHLARRLVQVGVNDVFSVPGDFNLTLLDHLIAEPGLNNIGCCNELNAGYAADGYARSRGVGACVVTFTVGGLSVLNAIAGAYSENLPLICIVGGPNTNDYGTNRILHHTIGLPDFSQELRCFQTVTCYQAVVNNLEDAHEQIDTAISTALKESKPVYISVSCNLPSIPHPSFSREPVPFVLTPRLSNKMGLEAAVEATAEFLNKAVKPVLVGGPKLRVAKACNAFVELADACGYPVSVMPSAKGFVPENHPRFIGTYWGAVSTAFCAEIVESADAYLFAGPIFNDYSSVGYSLLLKKEKAIIVHPDRVVIANGPSFGCILMKDFLSALAKRLKPNPTAYENYHRIYVPDGIPLKCAPQEPIRVNILFKHIQAMLSGDTAVIAETGDSWFNCQKLKLPKGCGYEFQMQYGSIGWSVGATLGYAQAAKDKRVIACIGDGSFQVTAQDISTMLTCGQNTIIFLINNGGYTIEVEIHDGPYNVIKNWNYTGLVEAIHNGQGKCWTAKVRCEEDLVEAIETATGEKKDCLCFIEVICHKDDTSKELLEWGSRVSAANSRPPNPQ

SEQ ID NO: 6229 - protein, 606 aa, Castanea mollissima
MDTKIGALDACPHTSTDLCTVPSNGAVSTIQSSTPSTIVTPSDATLGRHLARRLVQIGVTDIFSVPGDFNLTLLDHLIAEPGLTNVGCCNELNAGYAADGYARSRGVGACVVTFTVGGLSVLNAIAGAYSENLPLICIVGGPNSNDYGTNRILHHTIGLPDFSQELRCFQTVTCYQAVVNNLEDAHELIDTAISTSLKESKPVYISISCNLAGVPHPTFSREPVPFSLNPRLSNKMGLEAAVEAAAGFLDKAVKPVLVGGPKLRVANATDAFVELADACGYPLAVMPSAKGLVPEHHPHFIGTYWGAVSTPFCAEIVESADAYLFAGPIFNDYSSVGYSLLLKKEKAIIVQPDRVVIGNGPAFGCILMKDFLTALGKRLKRNTTAYENYHRIFVPEGHPLKSAPKEPLRVNVLFQHIQNMLSSETAVIAETGDSWFNCQKLKLPRGCGYEFQMQYGSIGWSVGATLGYAQAVPEKRVIACIGDGSFQVTAQDVSTMIRYGQRTIIFLINNGGYTIEVEIHDGPYNVIKNWNYTGLVDALHNGEGKCWTTKVHCEEELIEAINTATGDKKDNLCFIEVVVHKDDTSKELLEWGSRVSAANSRPPNPQ

SEQ ID NO: 6230 - protein, 492 aa, Cajanus cajan
GGGGLSVLNAIAGAYSENLPLICIVGGPNSIDYGTNRILHHTIGLPDFSQELRCFQTVTCFQAVVNNLDDAHELIDTAISTSLKERKPVYISIGCNLPGIPHPTFSRDPVPFSLSPRLSNKMGLEAAVEAAAEFLNKAVKPVLVGGPKLRVATASDAFVELADACGYALAVMPSAKGMVPEHHPHFIGTYWGAVSTAFCAEIVESADAYLFAGPIFNDYSSVGYSLLLKKEKAIIVQPDRVVIANGPAFGCVLMKDFLKALAKRLKHNNTAYENYHRIYVPEGHPLKAAPKEPLRVNVMFKHIQNMLSGETAVIAETGDSWFNCQKLKLPKGCGYEFQMQYGSIGWSVGATLGYAQAVPEKRVIACIGDGSFQVTAQDVSTMLRCAQKTIIFLINNGGYTIEVEIHDGPYNVIKNWNYTALVDAIHNGEGKCWTAKVFCEEELVEAIATATGPKKDSLCFIEVIVHKDDTSKELLEWGSRVSAANSRPPNPQ

SEQ ID NO: 6231 - protein, 607 aa, Glycine max
MDTNIGSLSLDACKPANNDVGCPPNGAVSAIKPSVPATTMTSSDATLGRHLARRLVQVGVTDVFSVPGDFNLTLLDHLIAEPQLKNIGCCNELNAGYAADGYARCRGVGACVVTFTVGGLSVINAIAGAYSENLPLICIVGGPNTNDFGTNRILHHTIGLSDFSQELRCFQTVTCYQAVVNNIEDAHELIDTAISTCLKESKPVYISISCNLPGIPHPTFSREPVPFSLSPRLSNKMGLEAAVEAAAEFLNKAVKPVMVGGPKLRVANACDAFVELADACGYPFAVMPSAKGLVPEHKPHFIGTFWGAVSTAFCAEIVESADAYLFAGPIFNDYSSVGYSLLLKKEKAIIVQPERVVISNGPAFGCVLMKDFLRELAKRLKHNNTAYENYSRIFVPEGKPVKAEPREPLRVNVLFKHIQDMLSGETAVIAETGDSWFNCQKLKLPKGCGYEFQMQYGSIGWSVGATLGYAQAVPEKRVISCIGDGSFQVTAQDVSTMLRNEQKTIIFLINNGGYTIEVEIHDGPYNVIKNWNYTGLVDAIHNGEGKCWTTKVTCEEELVEAIQTATGDKKDCLCFIEVIVHKDDTSKELLEWGSRVCAANGRPPNPQ

SEQ ID NO: 6232 - protein, 511 aa, Amsonia hubrichtii
MDTKIGPLDVVKPQSNDVGCLPTNGAVTIQQTSVPIGSADATLGRHLAHRLVQIGVNDVFAVPGDFNLTLLDHLIAEPGLNLIGCCNELNAGYAADGYARSRGVGACAVTFTVGGLSILNAIAGAYSENLPVICIVGGPNSNDYGTSRILHHTIGLPDFSQELRCFQTVTCYQAVVNNLEDAHEAIDTAISTALKESKPVYISISCNLPAIPHPTFSREPVPFSLSPKLSNQMGLAAAVEAAAEFLNKSVKPVMVGGPKMRVAKACDAFVELADTSGYALAVMPSAKGLVPEHHPHFIGTYWGAVSTAFCAEIVESADAYLFAGPIFNDYSSVGYSLLLKKEKAIIVQPERVTIGNGPAFGCVLMKDFLRELAKRLKHNNTAYENYHRIFVPDGHPLKCEPKEPLRVNVLFEHIQRMLSGDSAVIAETGDSWFNCQKLKLPKGCGYEFQMQYGSIGWSVGATLGYAQAVPERRVIACIGDGSFQVTAQDVSTMIRCGQKTIISHKQWWLYN

SEQ ID NO: 6233 - protein, 604 aa, Malus domestica
MDTKIGSLDVCKPACTNVGSLPNGAASAIQSTAPSTVNSSDATLGRHIARRLVQIGVTDVFTVPGDFNLTLLDHLIAEPGLTNIGCCNELNAGYAADGYARSRGVGACVVTFTVGGLSVLNAIAGAYSENLPLICIVGGPNSNDYGTHRILHHTIGLPDFSQELTCFQTVTCYQAMVNNLEDAHEMIDTAISTALKESKPVYISISCNLAGIPHPTFSRDPVPFSLSPRLSNHLGLEAAVEAAAEFLNKAVKPVMVGGPKLRVAHAGDAFVELADASGYALAVMPSAKGLVPEHHPHFIGTYWGAVSTAFCAEIVESADAYLFAGPIFNDYSSVGYSLLLKKEKAIVVQPDRVTIANGPSFGCVLMKDFLRALAKRLKHNKTAHENYSRIFVPNGHPLKSAPKEPLRVNVLFHHIQNMLSSETAVIAETGDSWFNCQKLKLPAGCGYEFQMQYGSIGWSVGATLGYAQAVPEKRVIAFIGDGSFQVTVQDVSTMIRNGQKNIIFLINNGGYTIEVEIHDGPYNVIKNWNYTGLVDAIHNGEGKCWTTKVRCEEELIEAIETATGAKKDSLCFIEVIAHKDDTSKELLEWGSRVSAANSRSPNPQ

SEQ ID NO: 6234 - protein, 605 aa, Gossypium hirsutum
MDTNIGSLDSCKPTSNDVCCPANVTVSTIQGSVSPTIINSSEATLGRHLARRLVQIGISDVFSVPGDFNLTLLDHLIAEPGLNLIGCCNELNAGYAADGYARSRGVGACVVTFTVGGLSVLNAIAGAYSENLPLICIVGGPNSNDYGTNRILHHTIGLPDFSQELRCFQTVTCYQAVVNNLEDAHEMIDTAISTALKESKPVYISISCNLPAIPHPTFAREPVPFSLSPKLSNKIGLEAAVEAAAEFLNKAVKPVLVGGPKLRVAKACEAFVELADASGYAVAVMPSGKGLVPEHHPHFIGTYWGAVSTAFCAEIVESADAYLFAGPIYNDYSSVGYSLLLKKEKAIIVQPDRVVIGNGPAFGCVLMKDFLRELAKRLKHNNTAYENYHRIFVPEGQPLKAAPKDPLRVNVLFQHIQKMLSSDSAVIAETGDSWFNCQKLKLPAGCGYEFQMQYGSIGWSVGATLGYAQAVPEKRVIACIGDGSFQVTAQDVSTMLRCGQKTVIFLINNGGYTIEVEIHDGPYNVIKNWNYTALVDAIHNGEGKCWTAKVFCEEELIEAIETATGAKKDCLCFIEVMVHKDDTSKELLEWGSRVSAANSRPPNPQ

SEQ ID NO: 6235 - protein, 209 aa, Triticum aestivum
  misc_feature (11)..(11): Xaa can be any naturally occurring amino acid
  misc_feature (19)..(19): Xaa can be any naturally occurring amino acid
TVSGDLSAIIXTYGRRVPXICQKYIECPALFQGRKFDLRYIVLVRSICPLDILLCDVFWVRLANNQYTLEKTSLFEYETHFTVMNYNGRMNHMNTPEFVKAFEKEHQVKWLEIHESIRIMIRRVFESASAVHPEMQNSFCRAIYGVDVMLDDKFKPKILEVTYCPDCTRACQYDTQALVGSQGPIKGSDFFNTVFGCLFLDDLTNVSPL

SEQ ID NO: 6236 - protein, 548 aa, Triticum aestivum
LELFSGFTQLQELEVDIPGPLGDSAISILESLPNINLLNGVNASTIVENAKHVVDSALRPRVPEWSPEESLAERVIGAMWLYLMTYRLADEEKFDETPIWYVMDELGSAMRHSDDANFRISPFLFMPEGKLASAISYTILWPICDVHTGEECTRDFLFGIGEDKQRSARLTAWFHTPEKYFIQEFRKYQEQLQSTTICPTKEAPSTKSALPSDGRPLRVFTDIPQVEEFLTRPEFVLTTDPKDADIIWAGMQIDSELKSSLGLTDQQYMNQFPFEACLVMKHHLADTIHRAWGSPEWLQPTYNLETHLSQLIGDYSVRKRDGKDNLWIMKPWNMARTIDTTVSGDLSAIIRLMETGPKICQKYIECPALFQGRKFDLRYIVLVRSICPLDILLCDVFWVRLANNQYTLEKTSLFEYETHFTVMNYNGRMNHMNTPEFVKAFEKEHQVKWLEIHESIRIMIRRVFESASAVHPEMQNSFCRAIYGVDVMLDDKFKPKILEVTYCPDCTRACQYDTQALVGSQGPIRGSDFFNTVFGCLFLDDLTNVSPL

SEQ ID NO: 6237 - protein, 440 aa, Avena sativa
MRHSDGANFRIAPFLFMPEGKLTSAVSYTIMWPICDVHTGEECTRDFLFGIGEDKQRSARLTAWFHTPENYFIQEFRKYQEQLESTSICPSTKEIPSTKSVRPSDGRALRVLTDISQVEDFLTRPEFVLTTDPQDADIIWLGAQVDSELKSSLGLTGQQYTNQFPYEACLVMKHHLADTIHKAWGSPEWLQPTYNLETHLSQLIGDYCVRKRDGMDNLWIMKPWNMARTIDTTVSGDLSAIIRLIETGPKICQKYIEHPALFQGRKFDLRYIVLVRSICPLDIFLTDVFWVRLANNQYTLEKTSFFEYETHFTVMNYTGKMNHMNTPEFVKEFEKEHQVKWLEIHENIRKMIRRVFESASAVHPEMQNTFSRAIYGVDVMLDNKFKPKILEVTYCPDCTRACQYDTRALVGSQGPIRGSDFFNTVFGCLFLDDLTNVSPL

SEQ ID NO: 6238 - protein, 496 aa, Pennisetum glaucum
HIVDSALQPRLPEWSSEESLAERVISAMWLYLMTYRLADEEKIDETPVWYVMDELGSAMRHSDNPNFRIAPFLFMPEGKLATAISYTILWPTDDVHTGDECTRDFLFGIGEEKQRSARLTAWFHTPENYFIQEFRKYKEQLQMNSICSSTKTKETPSTKSVRPSDGRALDIPHVEEFLTRPEFVLTTDPKKADIIWVSMQVDSEVKKALGLTDQQYTNQFPFEACLVMKHHLAETIHKAWGSPEWLQPTYNLEAHLSPLIGDYCKRKRDGMDNLWIMKPWNMARTIDTTVTGDLSAIIRLMETGPKICQKYIERPALFQGRKFDLRYIVLVRSICPLEIFLSDVFWVRLANNQYTLEKTSFFEYETHFTVMNYIGRMNHMNTPEFVKEFEKEHQVKWLEIHESIRSMIRCVFESATAVHPEMQNPFSRAIYGVDVMLDNRFKPKILEVTYCPDCGRACKYDTQALVGSQTTIKGSDFFNTVFGCLFLDEQTNVSPL

SEQ ID NO: 6239 - protein, 163 aa, Leymus cinereus x Leymus triticoides
ICPLDILLCDVFWVRLANNQYTLEKTSLFEYETHFTVMNYNGRMNHMNTPEFVKAFEKEHQVKWLEIHESIRNMIRCVFESASAVHPEMQNSFCRAIYGVDVMLDDRFKPKILEVTYCPDCTRACQYDTQALVGSQGPIRGSDFFNTVFGCLFLDDLTNVSPL

SEQ ID NO: 6240 - protein, 401 aa, Setaria italica
ECTRDFLFGIGEEKQRSARLTAWFHTPENYFIQEFRKYQEQLQTNSICSSTKTKEAPSTKSVRPSDGRALRVYTDIPHVEEFLTRPEFVLTTDPKEADIIWVSMQVDSEVKNALGLTDKQYTNQFPFEACLVMKHHLAETIHKAWGSPEWLQPTYNLETHLSPLIGDYCTRKRDGVDNLWIMKPWNMARTIDTTVTGDLSAIIRLMETGPKICQKYIECPALFQGRKFDLRYIVLVRSIRPLEIFLSDVFWVRLANNQYTLEKTSFFEYETHFTVMNYIGRMNHMNTPEFIKEFEKEHQVKWLEIHESIRSTIRCVFESATAVHPEMQNPFSRAIYGVDVMLDNRFKPKILEVTYCPDCGRACKYDTQALVGNQNTIKGSDFFNRVFGCLFLDEQTNVSPL

SEQ ID NO: 6241 - protein, 298 aa, Saccharum officinarum
MQVDSEVKKAVGLTDQQYTNQFPFEACLVMKHHLAETIHKAWGSPEWLQPTYNLETHLSPLIGDYFVRKRDGMDNLWIMKPWNMARTIDTTVTGDLSAIIRLMETGPKICQKYIERPALFQGRKFDLRYIVLVRSIRPLEIFLSDVFWVRLANNQYTLEKTSLFEYETHFTVMNYIGRMKHMNTPEFVKEFEKEHQVKWLDIHESIRSMIRCVFESAAAVHPEMQNPFSRAMYGVDVMLDNRFKPKILEVTYCPDCGRACKYDTQALVGSQDTIRRRDFFNTVFGWLFLDEQTNVSPL

SEQ ID NO: 6242 - protein, 168 aa, Cenchrus ciliaris
  misc_feature (61)..(61): Xaa can be any naturally occurring amino acid
  misc_feature (69)..(70): Xaa can be any naturally occurring amino acid
  misc_feature (78)..(78): Xaa can be any naturally occurring amino acid
  misc_feature (81)..(84): Xaa can be any naturally occurring amino acid
  misc_feature (91)..(91): Xaa can be any naturally occurring amino acid
  misc_feature (136)..(136): Xaa can be any naturally occurring amino acid
VLVRSIHPLEIFFSDVFWVRLANNQYTLEKTSFFEYETHFTVMNYTGRMNHMNTPEFVKEXEKEHQVKXXEIHESIRXMIXXXXESATAVXPEMQNPFSRAIYGVDVMLDNRFKPKILEVTYCPDCGRACKYDTQXLVGSQSTIKGSDFFNTVFGCLFLDEQTNVSPL

SEQ ID NO: 6243 - protein, 545 aa, Zea mays
MSPAVASASSGDRIRTYEDFVRVHAYLLAAAGIPPSLHRRLYRKLADEVFDGGEVFAVEPCEDGRQRRLVLTADQSLGKESDVFLVDHAWSFRLPDALKQLREVPGLAERMAALMCVDLDRKIEADEQDDDESGSLEHVSQVVEKERARVQERSDSTAWLELEELGIDDDMLVALDLSANFPNLVALNLWGNKLRDPEKVMQEIRKCTKLKALWLNENPVLGKSIDKAVFDGLSGLEIYNSHFTSKAGEWALGFCADIVGADNPCSSVESTLFGSIGTIDLSDRCIHKLPEVFSPSKLPSLSKLNIRGNPLDQISGDDLLKLFGGFTQLQELEVDIPGPLGNSAISILESLPNLSLLNGVDSSSIIESGKHIVDSALEPRLPEWSPEEPLAERVIGAMWLYLMTYRLADDEKIDETPVWYVMDELGSAMRHSDNANFRIAPFLFMPEGKLHTAISYTILWPTHDVHTGEECTRDFLFGIGEDKQRSARLTAWFRTPENYFIQEFRRYQEQLQSNSICSSTKIEETQTPSTQKCTLKGWSRPSSIY

SEQ ID NO: 6244 - protein, 171 aa, Lolium multiflorum
RYIVLVRSICPLDIFLTDVFWVRLANNQYTLEKTSFFEYETHFTVMNYTGKMNHMNTPEFVKEFEKEHQVKWLEIHENIRNMIRRVFESASVVHPEMQNEFCRAIYGVDVMLDNKFKPKILEVTYCPDCTRACQYDTRALVGSQGPIRGTDFFNTVFGCLFLDDLTNVSPL

SEQ ID NO: 6245 - protein, 241 aa, Brachypodium distachyon
MTVSFALRLGPPASATSGGGGRPTGTRALVSKRPNKEQHLWIRKDSAGSGKKALRLVNTVSKLPNGKEAVYGALDRWTAFETEFPIIAAAKALEMLKRQRQWIQIIQVTKWLMSKGQVLTWTTYDTLLLALFMDGRLDEAESIWNTVIQKHTRSVPKRLFSRMILIYDSRRLPDKVLEVFADMEELGVHPDEDTTRRIGRAFASSGQEDKQKPVLEKYLKKWKYIHFNGERVRVRRAGPLA

SEQ ID NO: 6246 - protein, 113 aa, Triticum aestivum
  misc_feature (38)..(38): Xaa can be any naturally occurring amino acid
MKVHATIWDGDTWATRGGRVKIDWAHAPFVASYGTYAXSACVSAAGNGDQDGAPSAFCCPGDASSWMARRLGPDGERAVAWARDTYMVMDYCDDPWNLGRPAECDMDQLASAV

SEQ ID NO: 6247 - protein, 472 aa, Saccharum officinarum
APVEQKFNLHLMVNTDRELLAQKVAPHRDFYNVRKVDTHVHHSACMNQKHLLRFIKSKLRKEPNEVVIFRDGTYLTLKEVFESLDLTGYDLNVDLLDVHADKSTFHRFDKFNLKYNPCGQSRLREIFLKQDNLIQGRFLAELTKEVFSDLQASKYQMAEYRISIYGRKKSEWDQMASWIVNNELYSENVVWLIQIPRIYNVYREMGTINSFQNLLDNIFLPLYEVTVDPASHPQLHVFLEQVVGLDLVDDESKPERRPTKHMPTPEQWTNVFNPAYAYYVYYCYANLYTLNKLRESKGMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSVAASLWKLSSCDLCENARNSATSPVSLTGSSLTGSGETTTKGVRRAMTSTRQMFLTSGLNFDTLSGKKKWS

SEQ ID NO: 6248 - protein, 822 aa, Manihot esculenta
MDTYTVHLTMAALLGASLVAVSAYYMHRKTLTQLLEFAKTVERERERERDDNSDGDSPQHLKKRRSHGRRKGNGYYRRGSASLPDVSAISGGGGGVDGMEKRNGPLHVDGIPPGLPRLHTLPEGSDEEDNMTDSTKIDITYIHTNGNAAAGPECKGLFDNLPKQVNANGEQIPIPASSMIRSHSVSGDLHGVQPDPIAADILRKEPEQETFARLKISPTEVPSPDEVESYIVLQECLEMRKRYVFKEAIAPWEKEVISDPSTPKPNPEPFFYAPEGKSDHYFEMQDGVIHVYADKDSQEELFPVADATTFFTDLHHILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLKEVFESLDLTGRYDLNVDLLDVHADKSTFHRFDKFNLKYNPCGQSRLREIFLKQDNLIQGRFLAEVTKQVFSDLSASKYQMAEYRISIYGRKQSEWDQLASWIVNNELYSENVVWLIQLPRLYNVYKEMGIVTSFQNILDNIFIPLFEVTVDPDSHPQLHVFLKQVVGLDLVDDESKPERRPTKHMPTPAQWTNVFNPAYSYYVYYCYANLYTLNKLRESKGMTTIKFRPHSGEAGDIDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGREYYKRGPDGNDIHKTNVPHIRVEFRETIWREEMQQVYLGKAIIPAELDK

SEQ ID NO: 6249 - protein, 873 aa, Aquilegia formosa
MEPYTLHLAMAALVGASFVAVSAYYMHRKTLTQLLEFAKTVERERDREFSSGVGDGVGEDEQVEKDDSPQHYNNINKKYSDKRKNHNKRNKASNYYRRASTSLPDVTVISDLEEKRNGSVLLDDRNFSIPAGLPRLHTLPEGQSVSRASCAKRSGHMIRPPSPKSPVASASAFESLEGSDEEDNLTDNSKLDNGYLHDNGNGGAECKSLFQNMPDQNNNKVDQNPLPAASMIRSHSVSGDLHGVQPDPVAADILRKEPEQETFVRLRISPTEVPSPDEAEVYLVLQDCLRLRESYVFREEVAPWEKEVITDPSTPKPNPNPFSYSPEGKTDHYFQMEDGVVQVYANKDSTEKLFPVADATTFFTDLHRILRVTAAGNIRTLCHHRLVLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKQVFSDLTASKYQMAEYRISIYGRKQSEWDQLASWIVNNDLYSENVVWLIQLPRLYNVYKEMGIVTSFQNILDNIFLPLFEVTVDPDSHPQLHIFLKQVVGLDLVDDESKPERRPTKHMPTPAQWTNIFNPAFSYYVYYCYANLYTLNKLRESKGMTTIKLRPHSGEAGDIDHLAATFLTSHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKSYYKRGPDGNDIHKTNVPHIRVEFRDTIWKEEMQQVYLGKAQIPEVVDE

SEQ ID NO: 6250 - protein, 831 aa, Fragaria vesca
MESYAVHLAMAALVGASLVAVSAYYMHRKTLTQLLEFAKTVERERDENSDGGDADSPQQMRKRRGQRRKGGGYYRRGSGSLPDVTAISGGVDGNGMVDGIPAGLPRLHTLPEGKSADHVGSTKRTAIRAVSPKSPVASASAFESVEGSDDEDNLTDNAKVYHANGNAGPDLPNHVTTNGEQIAIAASSMIRSHSVSGDLHGVQPDPIAADILRKEPEQETFARLQITPTELPSSDEVEVYVVLQECLELRKRYLFSEAVAPWEREVISDPSTPKPNPEPFFYTSEGKSDHHFEMQDGVIHVYPNKDSKEELYPVADATTFFTDLHHILRVIAAGNIRTLCHHRLNLLEQKFNLHLMLNADKEFLAQKSAPHRDFYNVRKVDTHVHHSACMNQKHLLRFIKSKLRKEPDEVVIFRDGTYLTLREVFESLDLNGYDLNVDLLDVHADKSTFHRFDKFNLKYNPCGQSRLREIFLKQDNLIQGRFLAELTKQVFSDLSASKYQMAEYRISIYGRKQSEWDQMASWIVNNELYSENVVWLIQLPRLYNIYKEMGIVTSFQNILDNIFIPLFEVTVDPDSHPQLHVFLKQVVGLDLVDDESKPERRPTKHMPTPAQWTNVFNPAFSYYVYYCYANLYTLNKLRESKGMTTIKFRPHSGEAGDIDHLAATFLTATNIAHGINLRKSPVLQYLYYLAQIGLAMSPLSNNSLFLDYHRNPFPVFFLRGLNVSLSTDDPLQIHLTKEPLVEEYSIAASVWKLSSCDLCEIARNSVYQSGFSHALKSHWIGREYYKRGPDGNDIHKTNVPHIRVEFRETIWREEMKQVYLGKARIPREVDR

SEQ ID NO: 6251 - protein, 528 aa, Quercus alba
NKDSKEELFPVADATTFFTDLHHILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKQVFSDLDASKYQMAEYRISIYGRKQSEWDQMASWIVNNELYSENVVWLIQLPRLYNVYKEMGIVTSFQNILDNIFIPLFEVTVDPDSHPQLHVFLKQVVGLDLVDDESKPERRPTKHMPTPAQWTNVFNPAFSYYVYYCYANLYTLNKLRESKGMTTIKFRPHSGEAGDIDHLAATFLTAHNIAHGINLRKSPVLQYLYYLAQIGLAMSPLSNNSLFLDYHRNPFPTFFLRGLNVSLSTDDPLQIHLTKEPLVEEYSIAASVWKLSSCDLCEIARNSVYQSGFSHALKSHWIGKEYYKRGPSGNDIHRTNVPHIRLEFRDTIWRDEMRQVYLGKPIIPEEVDK

SEQ ID NO: 6252 - protein, 821 aa, Ricinus communis
MDTNYTVHLAMAALVGASLVAVSAYYMHRKTLTQLLEFAKTVERDRDDNNSDLDSPLHLKQKRRSHHGGGGRRKGNGYYRRGSASLPDVTVISAGDGEEKRNGKAASHPKRSGNLIRPTSPKSPVASASAFESMEGSDEEDNLTDNSKLDTAYLHTNGNAVTEHINANGEQIPIPASTLIRSHSVSGDLHGVQPDPIAADILRKEPEQETFARLKVTPTEVPSPDEVESYIVLQECLEMRKRYIFKEAIAPWEKEIISDPGTPKPNPDPFFYAPEGKSDHYFEMQDGVIHVYPNKDCKEELFPVADATTFFTDLHHILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKQVFSDLGASKYQMAEYRISIYGRKQSEWDQLASWIVNNELYSENVVWLIQLPRLYNIYKEMGIVTSFQNILDNIFIPLFEVTVDPDSHPQLHVFLKQVVGLDLVDDESKPERRPTKHMPTPAQWTNVFNPAFSYYVYYCYANLYTLNKLRESKGMTTIKFRPHSGEAGDIDHLAATFLTSHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKEYYKRGPDGNDIHRTNVPHIRLEFRDTIWREEMRQVYLGKPVIPVEVDK

SEQ ID NO: 6253 - protein, 491 aa, Vigna unguiculata
DHRLNLLEQKFNLHLMLNADREFLAQKSAPHRDFYNVRKVDTHVHHSACMNQKHLLRFIKSKLRKEPDEVVIFRDGTYLTLKEVFKSLDLTGYDLNVDLLDVHADKSTFHRFDKFNLKYNPCGQSRLREIFLKQDNLIQGRFLGEVTKQVFSDLAASKYQMAEYRISIYGRKQSEWDQLASWIVNNDLYSENVVWLIQLPRLYNVYKEMGIVTSFQNMLDNIFIPLFEVTVDPDSHPQLHVFLKQVVGLDLVDDESKPERRPTKHMPTPEQWTNVFNPAFSYYVYYCYANLYTLNKLRESKGMTTIKFRPHSGEAGDIDHLAATFLTAHNIAHGINLKKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKEYYKRGPNGNDIQRTNVPHIRLEFRDTIWKEEMQQVYLGKAVIPEEVEK

SEQ ID NO: 6254 - protein, 331 aa, Castanea mollissima
MAEYRISIYGRKQSEWDQMASWIVNNELYSVNVVWLIQLPRLYNVYKEMGIVTSFQNILDNIFIPLFEVTVDPDSHPQLHVFLKQVVGLDLVDDESKPERRPTKHMPTPAQWTNVFNPAFSYYVYYCYANLYTLNKLRESKGMTTIKFRPHSGEAGDIDHLAATFLTAHNIAHGINLRKSPVLQYLYYLAQIGLAMSPLSNNSLFLDYHRNPFPTFFLRGLNVSLSTDDPLQIHLTKEPLVEEYSIAASVWKLSSCDLCEIARNSVYQSGFSHALKSHWIGKEYYKRGPSGNDIHRTNVPHIRVEFRDTIWREEMRQVYLGELVIPEEVDK

SEQ ID NO: 6255 - protein, 844 aa, Malus domestica
MESYALHLAMAALVGASVVAASAYYMHRKTLTQLLEFAKTVEKEREGDSDGGGGGDSPQNMKKRRSHARRKGNGYYRRNAASLPDVTAISGGIDGDDHRRNGFLPVDGIPAGLPRLHTLPEGKSTELANSVKRTGSLIRPISPKSPVASASAFESVEGSDDEDNMTDNSKLGTEGPDGKIIYENLPNHVNANGEQIPIAPTSMIRSHSVSGDLHGVQPDPITADILRKEPEQETFARLKITPIEVPSSDEAEVYVVLQECLELRKRYLFTETVAPWEKEIISDPSTPKPNPAPFSYTSEGKSDHYFEMQDGVVHVYPNKDSKELFPVADATTFFTDLHHILRVTAAGNIRTLCHHRLNLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKQVFSDLAASKYQMAEYRISIYGRKQSEWDQMASWIVNNELYSENVVWLIQLPRLYNIYKEMGIVTSFQNILDNIFIPLFEVTVDPDSHPQLHVFLKQVVGLDLVDDESKPERRPTKHMPTPAQWTNVFNPAFSYYVYYCYANLYTLNKLRESKGMTTINLRPHSGEAGDIDHLAATFLTATNIAHGINLRKSPVLQYLYYLSQIGLAMSPLSNNSLFLDYHRNPFPMFFLRGLNVSLSTDDPLQIHLTKEPLVEEYSIAASVWKLSSCDLCEIARNSVYQSGFSHALKSHWIGREYYKRGPDGNDIHRTNVPHIRLEFRDTIWRDEMQQVYLGKAIIPKEVDR

SEQ ID NO: 6256 - protein, 126 aa, Tropaeolum majus
DKEFLAQKSAPHRDFYNVRKVDTHVHHSACMNQKHLLRFIKSKLRKEPDEVVIFRDGTYLTLREVFESLDLTGYDLNVDLLDVHADKSTFHRFDKFNLKYNPCGQSRLREIFLSRIILSKVVSLLS

SEQ ID NO: 6257 - protein, 846 aa, Glycine max
MDTHAVHLALAALVGASVVAVSAYYMHRKTLAQLLEFARTVEREADAGGSDAESPPAHAKKRRGSSRKRRNGGYRRGSASLPDVTAISGGFDGDEKRNGPVHVEGIPAGLPRLHTLREGKSSQSGSFKRSLLRPTSPKSPVASASAFESVEGSDDEDNMTDKVKLDTTYLHANGTVGPEGKIPFETLPNHVNANGEQMAITPSMIRSHSVSGDLHGVQPDPIAADILRKEPEHETFTRLRITPLEAPSPDEIEAYVVLQECLEMRKRYVFREAVAPWDKEVISDPSTPKPNPDPFLYIPEGNSDHYFEMQDGVIRVYPDRDAKEELFPVADATTFFTDLHHLLRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLEEVFKSLDLSGYDLNVDLLDVHADKSTFHRFDKFNLKYNPCGQSRLREIFLKQDNLIQGRFLGELTKQVFSDLAASKYQMAEYRISIYGRKQSEWDQLASWIVNNDLYSENVVWLIQLPRLYNVYKEMGIVTSFQNMLDNIFIPLFEVTVNPDSHPQLHVFLKQVVGLDLVDDESKPERRPTKHMPTPEQWTNVFNPAFSYYVYYCYANLYTLNKLRESKGMTTIKFRPHSGEAGDIDHLAATFLTAHNIAHGINLKKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKEYYKSGPRGNDIQRTNVPHIRLEFRDTIWKEEMQQVYLGKAIIPEEVDK

SEQ ID NO: 6258 - protein, 585 aa, Aristolochia fimbriata
LELRESYIFREEVPPWEKEVITEPGTPKSNPNPFAYVPEKKTDHHFQMEDGVVYVYANKDSTERLFPVVDATTFFTDLHRILKVIAAGNIRTLCHHRLVLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKQVFSDLGASKYQMAEYRISIYGRKQSEWDQLASWIVNNELYSDNVVWLIQLPRLYNVYKEMGIVTSFQNILDNIFLPLFEVTVDPDSHPQLHVFLKQVVGLDLVDDESKPERRPTKHMPTPEQWTNIFNPAYSYYVYYCYANLYTLNKLRESKGMSTIKFRPHSGETGDIDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHPLKSHWIGKSYYKRGPDGNDIHKTNVPHIRLEFRDTIWREEMQQVYLRKAKICEEIDN

SEQ ID NO: 6259 - protein, 862 aa, Brachypodium distachyon
MDDSSASSYKLQLSVAALVGASAAAASAYYLHCRAVAQLGGDIVRSSTAAAKSGLQRRRHREAGKPPPPRRTAAGSSSLPDLSAIYAAGGVARGYPVGEEYDDDEEGVGPYVDDALTAAAACMQIPEGLPRLQVGPDGNKQLGRSSSNRRVGLIRPNLPKSVPGASTFESVEGSDEDVAMKISGKLDNGYLNANGNLEGEHKGNAIMENGAAIPLAAKNLARSKSISNDLHGVQPDPVAADILRKEPEQESFVKLLTAPNEIPSPDEIEVYKILQKCLELRDCYLFREEVAPWEKEVINDPCTPKPNLNPFTYGPEPKSEHVFQMVDGVVQVYADKDYTERIYPVADATTFFTDLHYVLRVTAAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTMQVFSDLNASKYQMAEYRISIYGRKQSEWDQLASWIVNNELYSENVVWLVQIPRLYNVYKQMGIVTSFQNLLDNIFLPLFEVTVDPSSHPQLHVFLKQVVGLDLVDDESKPERRPTKHMPTPEQWTNVFNPAFSYYAYYCYANLYTLNKLRESKGMNTIKFRPHAGEAGDVDHLAATFLLCHSISHGINLRKSPVLQYLYYLGQIGLAMSPLSNNSLFLDYHRNPFPMFFQRGLNVSLSTDDPLQIHLTKEPLVEEYSIAASLWKLSSCDLCEIARNSVYQSGFSHALKAHWIGKNYYKRGPSGNDIHRTNVPHIRIEFRDLIWRDEMQLVYLNNVILPEEVDQ

SEQ ID NO: 6260 - protein, 834 aa, Gossypium hirsutum
MDTSTVHLAMAALVGASLVAVSAYYMHRKTLNQLLEFAKTVEREREDISEGEESPQPQHSKKRRGQHFRWKGNGYYRRGSASLPDVTVISGGFDGEEKRNGPVNVDGIPPGLPRLHTLPEAKRSGSLIRPTSPKSPSASAFESIEGSDDEDNITDSSKLDITYLHTNGNAGPNLPDHINANGEAMQIAASSMIRSHSIAGDLHGVQPDPIAADILRKEPEQETFARLKISPSEVPSPDEVEVYVVLQECLEMRKRYVFKEAVAPWEKEVISDPSTPKPNPEPFFYAPEGKSDHYFEMQDGVIHVYDNKDTRRELFPVADATTFFTDLHHILRVIAAGNIRTLCFHRLNLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKEVFSDLAASKYQMAEYRISIYGRKQSEWDQLASWIVNNDLYSENVVWLIQIPRLYNVYKEMGIVTSFQNILDNIFIPLFEVTVDPDSHPQLHVFLKQVVGLDLVDDESKPERRPTKHMPTPDQWTNVFNPAFSYYAYYCYANLYTLNKLRESKGMTTIKFRPHSGEAGDIDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSACDLCEIARNSVYQSGFSHALKSHWIGKEYYKRGPNGNEIQRTNVPHIRLEFRDRIWREEMQLVYLGNAIIPEEVDK

SEQ ID NO: 6261 - protein, 155 aa, Cajanus cajan
QGRFLGELTKQVFSDLAASKYQMAEYRISIYGRKQSEWDQLASWIVNNDLYSENVVWLIQLPRLYNVYKEMGIVTSFQNMLDNIFIPLFEVTVDPDSHPQLHVFLKQVVGWIWWMMKASLKGDQQNTCPHLISGLMYSIQHFHTMSITVMQIFTP

SEQ ID NO: 6262 - protein, 842 aa, Prunus persica
MESYAIHLAMAALVGASLVAVSAYYMHRKTLNQLLEFAKTVEREREDNSDGGDSPQHMKKRRSHARRKGSGYYRRCSASLPDVTAISGGIDGDDHRRNGLLPVDGIPAGLPRLHTLPEGKSTELASSAKRTGNLIRPTSPKSPVASASAFESVEGSDDEDNMTDNAKLGTVGPDGKILFENLPNHVNANGEQIPIAPSSMIRSHSVSGDLHGVQPDPIAADILRKEPEQETFAKLKITPTEVPSTDEVEVYVVLQECLELRKRYVFSETVAPWEKEIISDPSTPKPNPAPFFYTSEEKSDHYFEMQDGVVHVYPNKDSREELFPVADATTFFTDLHHILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKQVFSDLSASKYQMAEYRVSIYGRKQSEWDQMASWIVNNELYSENVVWLIQLPRLYNIYKEMGIVTSFQNILDNIFIPLFEVTIDPDSHPQLHVFLKQVVGLDLVDDESKPERRPTKHMPTPAQWTNVFNPAFSYYVYYCYANLYTLNKLRESKGMTTIKFRPHSGEAGDIDHLAATFLTANNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGREYYKRGPDGNDIHKTNVPHIRVEFRETIWREEMQQVYLGKAMIPKEVER

SEQ ID NO: 6263 - protein, 474 aa, Silene vulgaris
NADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKQVFSDLEASKYQMAEYRISIYGRKQSEWDQLASWIVNNDLYSENVVWLIQIPRLYNIYKEMGIVTSFQNLLDNIFLPLFEVTVDPDSHPHLHLFLKQVVGLDLVDDESKPERRPTKHMPTPDQWTNIFNPAYSYYVYYCYANLYTLNKLRESKGMTTIKFRPHCGEAGDVDHLAASFLTCHNIAHGINLRKSPVLQYLYYLAQIGLAMSPLSNNSLFLDYHRNPFPVFFLRGLNVSLSTDDPLQIHLTKEPLVEEYSIAASVWKLSSCDLCEIARNSVLQSGFSHALKTHWIGQQYYIRGPEGNDIHKTNVPHIRVEFRQMIWREEMQQVYLGKANIPEEVDK

SEQ ID NO: 6264 - protein, 688 aa, Glycine max
MTDKVKLDTTYLHANGTVGPEGKIPFETLPNHVNANGEQMAITPSMIRSHSVSGDLHGVQPDPIAADILRKEPEHETFTRLRITPLEAPSPDEIEAYVVLQECLEMRKRYVFREAVAPWDKEVISDPSTPKPNPDPFLYIPEGNSDHYFEMQDGVIRVYPDRDAKEELFPVADATTFFTDLHHLLRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLEEVFKSLDLSGYDLNVDLLDVHADKSTFHRFDKFNLKYNPCGQSRLREIFLKQDNLIQGRFLGELTKQVFSDLAASKYQMAEYRISIYGRKQSEWDQLASWIVNNDLYSENVVWLIQLPRLYNVYKEMGIVTSFQNMLDNIFIPLFEVTVNPDSHPQLHVFLKQVVGLDLVDDESKPERRPTKHMPTPEQWTNVFNPAFSYYVYYCYANLYTLNKLRESKGMTTIKFRPHSGEAGDIDHLAATFLTAHNIAHGINLKKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKEYYKSGPRGNDIQRTNVPHIRLEFRDTIWREEMQQVYLGKAIIPEVVDK

SEQ ID NO: 6265 - protein, 876 aa, Populus trichocarpa
MDAYALHLAMAALVGASFVAVSAYYMHRKTLTQLLEFAKTVERERERDDNSDGGGSSPQNLKKSRSHGRRKGSNGHYNKRGSASLPDVTAISGGGIDGEEKRNGQVLYVEGIPAGLPRLHTLLEGKSAGHVKRPASFIRPTSPKSPGASASAFDSVEGSDDEDNMTGNSKLDTTYLHINGNADIKDVLPQHINANGDQMPIPASSMIRSHSVSGDLHGVQPDPFAADILRKEPEQETFARLKISPMAEVPSPDEVDSYIVLQECLEMRKRYVFKEAIAPWEKEIISDPSTPKPNPDPFSYTPEGKSDHYFEMQDGVIHVYPNKDSKEELFPVADATMFFTDLHHILRVIAIGNIRTLCHHRLNLLEQKFNLHLMLNADREFLAQKSAPHRDFYNVRKVDTHVHHSACMNQKHLLRFIKSKLRKEPDEVVIFRDGTYLTLKEVFESLDLTGQGTFIAVLIFILLYREWWYLIDICLHRYDLNVDLLDVHADKSTFHRFDKFNLKYNPCGQSRLREIFLKQDNLIQGRFLGELTKQVFSDLVASKYQMAEYRISIYGRKQSEWDQLASWIVNNELYSENVVWLIQLPRLYNIYKEMGIVTSFQNILDNIFMPLFEVTVDPDSHPQLHVFLKQVVGLDLVDDESKPERRPTKHMPTPVQWTNVFNPAFSYYVYYCYANLYTLNKLRESKGMTTIKFRPHSGEAGDIDHLAATFLTCHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKEYYNRGPDGNDIHKTNVPHIRVEFRDTIWRDEMQQVYLGKAIIPKEVDK

SEQ ID NO: 6266 - protein, 379 aa, Euphorbia esula
  misc_feature (1)..(2): Xaa can be any naturally occurring amino acid
XXFNLKYNPCGQSRLMEIFLKQDNLIQGRFLAELTQQVFSDLDASKYQMAEYRISIYGRKQSEWDQLASWIVNNELYSENVVWLIQLPRLYNIYKEMGIVTSFQNILDNIFIPLFEVTVDPDSHPQLHVFLKQVVGLDLVDDESKPERRPTKHMPTPAQWTNVFNPAFSYYSYYCYANLYTLNKLRESKGMTTIKFRPHSGEAGDIDHLAATFLTAQNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKEYYKRGPDGNDIHRTNVPHIRVEFRETIWREEMQQVYLGKAIIPREVDK

SEQ ID NO: 6267 - protein, 129 aa, Arnica chamissonis
MPTPAQWTNIFNPAFSYYVYYCYANLYTLNKLRESKGMTTIRFRPHCGEAGDIDHLAAAFLTTHNIAHGINLRKSPVLQYLYYLAQIGLAMSPLSNNSLFWIITGTLFQHFSSEALMFLYLLMTRYKSI

SEQ ID NO: 6268 - protein, 834 aa, Gossypium hirsutum
MDTSTVHLAMAALVGASLVAVSAYYMHRKTLNQLLEFAKTVEREREDISEGEESPQPQHSKKRRGQHFRWKGNGYYRRGSASLPDVTVISGGFDGEEKRNGPVNVDGIPPGLPRLHTLPEAKRSGSLIRPTSPKSPSASAFESIEGSDDEDNITDSSKLDITYLHTNGNAGPNLPDHINANGEAMQIAASSMIRSHSIAGDLHGVQPDPIAADILRKEPEQETFARLKISPSEVPSPDEVEVYVVLQECLEMRKRYVFKEAVAPWEKEVISDPSTPKPNPEPFFYAPEGKSDHYFEMQDGVIHVYDNKDTRRELFPVADATTFFTDLHHILRVIAAGNIRTLCFHRLNLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKEVFSDLAASKYQMAEYRISIYGRKQSEWDQLASWIVNNDLYSENVVWLIQIPRLYNVYKEMGIVTSFQNILDNIFIPLFEVTVDPDSHPQLHVFLKQVVGLDLVDDESKPERRPTKHMPTPDQWTNVFNPAFSYYAYYCYANLYTLNKLRESKGMTTIKFRPHSGEAGDIDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSACDLCEIARNSVYQSGFSHALKSHWIGKEYYKRGPNGNEIQRTNVPHIRLEFRDRIWREEMQLVYLGKAIIPEEVEK

SEQ ID NO: 6269 - protein, 432 aa, Gossypium hirsutum
KSKLRKEPDEVVIFRDGTYLTLTEVFESLDLTGYDLNVDLLDVHADKSTFHRFDKFNLKYNPCGQSRLREIFLKQDNLIQGRFLGELTKQVFSDLAASKYQMAEYRISIYGRKQSEWDQLASWIVNNELYSENVVWLIQIPRLYNVYKEMGIVTSFQNILDNIFIPLFEVTVDPDSHPQLHVFLKQVVGLDLVDDESKPERRPTKHMPRPDEWTNVFNPAFSYYAYYCYANLYTLNKLRESKGMSTIKFRPHSGEAGDIDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKHYYKRGPGGNDIHKTNVPHIRLEFRDTIWREEMQLVYLGKADIPTDVDK

SEQ ID NO: 6270 - protein, 832 aa, Euphorbia peplus
MDAYTVHLAMAALVGASLVAVSAYYMHRKTLTQLLEFAKTVEGGRDADSDVDSPQHFKKRGGGRKKGRGYYRRGSGSLPDVTAVEGDEKRNGPVYVDGIPAGLPRLHTLAEGKAAGLPKRSGSIIRPTSPKSPVASASAFESIEGSDEEDNMTDNSKLDTAYLRTNGTVGGEHINSIPNGEQFPIPASSMIRSHSVSGDLHGVQPDPIAADILRKEPEHETFARLKIAPLEVPSPDEVEAYVVLQECLELRKRYVFKEAIAPWEKEIISEPGTPKPNTDPFFYAPEGKSDHYFEMQDGVIHVYPNKDSKEELFPVADATTFFTDLHHILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTQQVFSDLDASKYQMAEYRISIYGRKQSEWDQLASWIVNNELYSENVVWLIQLPRLYNIYKDMGIVTSFQNILDNIFIPLFEVTVDPDSHPQLHVFLKQVVGLDLVDDESKPERRPTKHMPTPAQWTNVFNPAFSYYSYYCYANLYTLNKLRESKGMTTIKFRPHSGEAGDIDHLAATFLTAQNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKEYYKRGPDGNDIHRTNVPHIRVEFRETIWREEMQQVYLGKAIIPREVDK

SEQ ID NO: 6271 - protein, 492 aa, Trigonella foenum-graecum
MPPQAKSSRQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKQVFSDLEASKYQMAEYRISIYGRKQSEWDQLASWIVNNELYSENVVWLIQLPRLYNIYKDMGIVTSFQNMLDNIFIPLFEVTVDPDSHPQLHVFLKQVVGLDLVDDESKPERRPTKHMPTPAQWTNVFNPAYSYYVYYCYANLYTLNKLRESKGMTTIKFRPHSGEAGDIDHLAATFLTAHNIAHGINLRKSPVLQYLYYLAQIGLAMSPLSNNSLFLDYHRNPLPIFFLRGLNVSLSTDDPLQIHLTREPLVEEYSIAASVWKLSSCDLCEIARNSVYQSGFSHALKSHWIGKEYYKRGPNGNDIHRTNVPHIRLEFRDTIWREEMQQVYLGKFIIPEEIEK

SEQ ID NO: 6272 - protein, 727 aa, Triticum aestivum
EGNKQIIRSGSSRRVGLIRPNSPKSPFASASTLESAEGSDEDAATKVNGKLDNGHANTNRNLEGEHKGNSVVENGAGTPLDAKNMTRSHSISNDLHAAQPDPVAADILRKEPQQESFIKLLTAPHEIPSPDEIEVYKILQKCLELRDCYLFREEVAPWEKEVINDPCTPKPNPNPFTFVPEPKSEHVFQMVDGVVQVYADKDRTERIYPVADATTFFTDLHYVLRMTAAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTMQVFSDLNASKYQMAEYRISIYGRKQSEWDQLASWIVNNELYSENVVWLIQIPRLYNVYQQMGIVTSFQNLLDNIFLPLFEVTIDPASHPQLHVFLKQVVGLDLVDDESKPERRPTKHMPTPEEWTNVFNPAFSYYAYYCYANLYTLNKLRESKGMNTIKFRPHAGEAGDVDHLAATFLLCHSISHGINLRKSPVLQYLYYLGQIGLAMSPLSNNSLFLDYHRNPFPMFFQRGLNVSLSTDDPLQIHLTKEPLVEEYSIAASLWKLSSCDLCEIARNSVYQSGFSHALKAHWIGKNYYKRGPSGNDIHRTNVPTIRIEFRDLIWRDEMQLVYLNNVILPDEVDQ

SEQ ID NO: 6273 - protein, 132 aa, Gossypium hirsutum
MAEYRISIYGRKQSEWDQLASWIVNNDLYSENVVWLIQIPRLYNVYKRWGLLLHFRTFLTTFLYLCLRLLWIQIHILSYMFLKQVVGLDLVDDESKPERRPTNTCQHQINGLMYLILHSPTMRIIATQTSIP

SEQ ID NO: 6274 - protein, 831 aa, Manihot esculenta
MDTNYTVHLAMAALVGASLVAVSAYYMHRKTLTQLLEFAKTVERDRDDNNSDLDSPLHLKQKRRSHHGGGGRRKGNGYYRRGSASLPDVTVISAGDGEEKRNGKAASHPKRSGNLIRPTSPKSPVASASAFESMDGSDEDDNMNDNAKLDTTYLHTNGIAGPESKGLFENLPEHANANGEQIPIPASSMIRSHSISGDLHGVQPDPIAADILRKEPEQETFARLKISPTEVPSPDEVESYIVLQECLEMRKRYLFKEAIAPWEKEVISDPSTPKPNPEPFFYAPEGKSDHYFEMQDGVIHVYANKDSKEELFPVADATNFFTDLHHILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLKEVFESLDLTGSDLNVDLLDVHADKSTFHRFDKFNLKYNPCGQSRLREIFLKQDNLIQGRFLAELTKEVFSDLAASKYQMAEYRLSIYGRKQSEWDQLASWIVNNELYSENVVWLIQLPRLYNVYKEMGIVTSFQNILDNIFIPLFEVTVDPDSHPQLHVFLKQVVGLDLVDDESKPERRPTKHMPTPAQWTNVFNPAYSYYVYYCYANLYTLNKLRESKGMTTIKFRPHSGEAGDIDHLAATFLTAHNIAHGINLRKSPVLQYLYYLAQIGLAMSPLSNNSLFLDYHRNPFPMFFLCGLNVSLSTDDPLQIHLTKEPLVEEYSIAASVWKLSSCDLCEIARNSVYQSGFSHVLKSHWIGKEYYKREPDGNDIRRTNVPHIRVEFRDTIWREEMQQVYLGKAIFSEWTSK

SEQ ID NO: 6275 - protein, 405 aa, Arachis hypogaea
SLDLTGYDLNVDLLDVHADKSTFHRFDKFNLKYNPCGQSRLREIFLKQDNLIQGRFLGEVTKQVFADLAASKYQMAEYRISIYGRKQSEWDQLASWIVNNELYSENVVWLIQLPRLYNVYKEMGIVTSFQNILDNIFIPLFEVTVDPDSHPQLHVFLKQVVGLDLVDDESKPERRPTKHMPTPAQWTNVFNPAFSYYAYYCYANLYTLNKLRESKGMTTIKFRPHSGEAGDIDHLAATFLTAHNIAHGINLRKSPVLQYLYYLAQIGLAMSPLSNNSLFLDYHRNPFPMFFSRGLNVSLSTDDPLQIHLTKEPLVEEYSIAASVWKLSACDLCEIARNSVYQSGFSHALKSHWIGQEYYKRGPDGNDIQKTNVPHIRLEFRDMIWRDEMQQVYLGKAVIPEVVDR

SEQ ID NO: 6276 - protein, 588 aa, Oryza sativa
QKCLELRDCYLFREEVAPWEKEVINDPCTPKPDPNPFTYVPEPKSEHVFQMVDGVVHVYADKDYTEILYPVADATTFFTDLHYMLRVISAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTKQVFSDLTASKYQMAEYRISIYGRKQSEWDNLASWIVNNELSSENVVWLVQIPRLYNVYKEMGIVTSFQTLLDNIFLPLFEVTIDPASHPQLHVFLKQVVGLDLVDDESKPERRPTKHMPTPEQWTNVFNPAFSYYAYYCYANLYTLNKLRESKGMTTIKFRPHAGEAGDIDHLAATFLLCHNISHGINLRKSPVLQYLYYLGQIGLAMSPLSNNSLFLDYHRNPFPMFFQRGLNVSLSTDDPLQIHLTKEPLVEEYSIAASLWKLSSCDLCEIARNSVYQSGFSHALKAHWIGKNYYKRGPTGNDIHKTNVPHIRVQFRDLIWRDEMRLVYLNNVILPDEVDQ

SEQ ID NO: 6277 - protein, 847 aa, Glycine max
MDTHAVHLALAAIVGASVVAVSAYYMHRKTLAQLLEFARTVEREADGGGGSDTEPPTAHLKKRLGSSRMRGNGGYRRGSASLPDVTAISGGFDGEEKRNGPVHVDGIPVGLPRLHTLREGKSSQSGSFKRSLLRPTSPKSPVASASAFESVEGSDDEDNMAGEVKLDTTYLHTNGTVVPEGKIPFETLPNHVNANGEQMAITPSMIRSHSVSGDLHGVQPDPIAADILRKEPEHETFTRLRITPLEAPSPDEVEAYVVLQECLEMRKRYVFSEAVAPWDKEVISDPSTPKPNPDPFLYILEGKSDHYFEMRDGVIHVYPDRDAKEELFPVADATTFFTDLHHILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLEEVFKSLDLTGYDLNVDLLDVHADKSTFHRFDKFNLKYNPCGQSRLREIFLKQDNLIQGRFLGELTKQVFSDLAASKYQMAEYRISIYGRKQSEWDQLASWIVNNDLYSENVVWLIQLPRLYNVYKEMGIVTSFQNMLDNIFIPLFEVTVNPDSHPQLHVFLKQVVGLDLVDDESKPERRPTKHMPTPEQWTNVFNPAFSYYVYYCYANLYTLNKLRESKGMTTIKFRPHSGEAGDIDHLAATFLTAHNIAHGINLKKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKEYFKSGPRGNDIQRTNVPHIRLEFRDTIWREEMQQVYLGKAIIPEVVDK

SEQ ID NO: 6278 - protein, 847 aa, Glycine max
MDTHAVHLALAAIVGASVVAVSAYYMHRKTLAQLLEFARTVEREADGGGSSDTEPPTAHLKKRLGSSRMRGNGGYRRGSASLPDVTAISGGFDGEEKRNGPVHVDGIPVGLPRLHTLREGKSSQSGSFKRSLLRPTSPKSPVASASAFESVEGSDDEDNMAGEVKLDTTYLHTNGTVVPEGKIPFETLPNHVNANGEQMAITPSMIRSHSVSGDLHGVQPDPIAADILRKEPEHETFTRLRITPLEAPSPDEVEAYVVLQECLEMRKRYVFSEAVAPWDKEVISDPSTPKPNPDPFLYILEGKSDHYFEMRDGVIHVYPDRDAKEELFPVADATTFFTDLHHILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLEEVFKSLDLTGYDLNVDLLDVHADKSTFHRFDKFNLKYNPCGQSRLREIFLKQDNLIQGRFLGELTKQVFSDLAASKYQMAEYRISIYGRKQSEWDQLASWIVNNDLYSENVVWLIQLPRLYNVYKEMGIVTSFQNMLDNIFIPLFEVTVNPDSHPQLHVFLKQVVGLDLVDDESKPERRPTKHMPTPEQWTNVFNPAFSYYVYYCYANLYTLNKLRESKGMTTIKFRPHSGEAGDIDHLAATFLTAHNIAHGINLKKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKEYFKSGPRGNDIQRTNVPHIRLEFRDTIWREEMQQVYLGKAIIPEVVDK

SEQ ID NO: 6279 - protein, 832 aa, Solanum lycopersicum
MDAHTVHLAMAALVGASIVAVSAYYMHRKTLNQLLELAKTIEKGKDLDGVETEEDGGGYSRNYAVRRRNRSRSNGYYRGSSASFPDVTMANSGEVEERRNGPIHVESIPAGLPRLHTLPEGKSRSTHSLRPTSPKSPVASASAFESIEGSDEEDNITDTTKLDTAYLQTNGNAGPDADGEQIALAAAASMIRSHSVSGDLHGVQPDPIAADILRKEPEQETFVRLKISPGETPSADEAEVYRNLQVCLEMRQSYVFKEAVAPWVKEVISDPCTPKPNPNPFEFTPEGKSDHYFQMEDGVVHVYANEDSTEKLFPVADATTFFTDFHHILKVIAAGNIRTLCHHRLVLLEQKFNLHLMLNADREFLAQKSAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTKQVFSDLSASKYQMAEYRISIYGRKMSEWDQLASWIVNNELYSENVVWLIQLPRLYNIYKEMGIVTSFQNILDNIFLPLFEVTVDPDSHPHLHIFLKQVVGLDLVDDESKPERRPTKHMPTPAQWTNVFNPAFSYYVYYCYANLYTLNKLRESKGMTTIKFRPHAGEAGDIDHLAATFLTSHNIAHGINLRKSPVLQYLYYLAQIGLAMSPLSNNSLFLDYHRNPLPMFFLRGLNVSLSTDDPLQIHLTKEALVEEYSIAASVWKLSSCDLCEIARNSVYQSGFSHALKSHWIGKEYYKRGPDGNDIHRTNVPHIRLEFRDMIWREEMQQVYLGKAVFPSFVDP

SEQ ID NO: 6280 - protein, 752 aa, Triticum aestivum
  misc_feature (32)..(32): Xaa can be any naturally occurring amino acid
  misc_feature (123)..(123): Xaa can be any naturally occurring amino acid
  misc_feature (229)..(229): Xaa can be any naturally occurring amino acid
VDEALLAAAAYMQIPTGLPRLQVGPEGNKQIXRSGSSRRVGLIRPNSPKSPFASASTLESAEGSDEDAATKVNGKLDNGHASTNGNLEGEHKGNSVVENGAGTPLDAKNMTRSHSISNDLHAXQPDPVAADILRKEPQQESFIKLLTAPHEIPSPDEIEVYKILQKCLELRDCYLFREEVAPWEKEVINDPCTPKPNPNPFTFVPEPKSEHVFQMVDGVVQVYADKDRXERIYPVADATTFFTDLHYVLRMTAAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTMQVFSDLNASKYQMAEYRISIYGRKQSEWDQLASWIVNNELYSENVVWLIQIPRLYNVYQQMGIVTSFQNLLDNIFLPLFEVTIDPASHPQLHVFLKQVVGLDLVDDESKPERRPTKHMPTPEEWTNVFNPAFSYYAYYCYANLYTLNKLRESKGMNTIKFRPHAGEAGDVDHLAATFLLCHSISHGINLRKSPVLQYLYYLGQIGLAMSPLSNNSLFLDYHRNPFPMFFQRGLNVSLSTDDPLQIHLTKEPLVEEYSIAASLWKLSSCDLCEIARNSVYQSGFSHALKAHWIGKNYYKRGPSGNDIHRTNVPTIRIEFRDLIWRDEMQLVYLNNVILPDEVDQ

SEQ ID NO: 6281 - protein, 797 aa, Populus trichocarpa
MEAYSLHLAMAALVGASFVAVSAYYMHRKTLNQLLEFAKTRGSASLPDVTAIYGGGIDGEEKRNGQVVYVEGIPAGLPRLHTLPEGKSSGHIKRPGSFIRPTSPKSPGASASAFDSVEGSDDEDNMTDNSKLDTTYLHVNGNAVNQVPIPASSMIRSHSVSGDLHGVQPDPIAADILRKEPEQETFARLKISPMAEVPSPDEVDSYIVLQECLEMRKRYVFKEAIAPWEKEIISDPSTPKPNPDPFSFTPEGKSDHYFEMQDGVIHVYPNKDSKEELFPVADATTFFTDLHHILRVIAIGNIRTLCHHRLNLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKQVFSDLSASKYQMAEYRISIYGRKQSEWDQLASWIVNNELYSENVVWLIQLPRLYNIYKEMGIVTSFQNILDNIFIPLFEVTIDPDSHPQLHVFLKQVVGLDLVDDESKPERRPTKHMPTPTQWTNVFNPAFSYYVYYCYANLHTLNKLRESKGMTTIKFRPHSGEAGDTDHLAATFLTSHNIAHGINLRKSPVLQYLYYLAQIGLAMSPLSNNSLFLDYHRNPFPMFFQRGLNVSLSTDDPLQIHLTKEPLVEEYSIAASVWKLSSCDLCEIARNSVYQSGFSHALKSHWIGKEYYKRGPDGNDIHRTNVPHIRVEFRDAIWRDEMQQVYLGKAVIPKEVDK

SEQ ID NO: 6282 - protein, 835 aa, Solanum phureja
MDAHTVHLAMAALVGASIVAVSAYYMHRKTLNQLLEFAKAIEKDRDPDDVETEDGGGGYSRNYAVKRRNRSGSKGSNGYYRGSSASFPDVMMAKSGEVEERRNGPIHVDSIPAGLPRLHTLPEGKSRSTHSLRPTSPKSPVASASAFESIEGSDEEDNITGTTKLDTAYLHTNGNAGPDADGEQIAVAAAASMIRSHSVSGDLHGVQPDPIAADILRKEPEQETFVRLKISPGETPSADEAEVYRNLQVCLEMRQSYVFKEAVAPWVKEVISDPCTPKPNPNPFEFTPEGKSDHYFQMEDGVVHVYANEDSTEKLFPVADATTFFTDFHHILKVIAAGNIRTLCHHRLVLLEQKFNLHLMLNADREFLAQKSAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTKQVFSDLSASKYQMAEYRISIYGRKMSEWDQLASWIVNNELYSENVVWLIQLPRLYNIYKEMGIVTSFQNILDNIFLPLFEVTVDPDSHPHLHIFLKQVVGLDLVDDESKPERRPTKHMPTPAQWTNVFNPAFSYYVYYCYANLYTLNKLRESKGMTTIKFRPHSGEAGDIDHLAATFLTSHNIAHGINLRKSPVLQYLYYLAQIGLAMSPLSNNSLFLDYHRNPLPMFFLRGLNVSLSTDDPLQIHLTKEALVEEYSIAASVWKLSACDLCEIARNSVYQSGFSHALKSHWIGKEYYKRGPDGNDIHRTNVPHIRLEFRDMIWREEMQQVYLGKAVFPSFVDP

SEQ ID NO: 6283 - protein, 572 aa, Pennisetum glaucum
PWEKEVINDPCTPKPNPNPFTYVPEQKSEHVFQMVDGVVHVYENKDYTESIYPVADATAFFTDLHYILRVTAAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTKQVFSDLSASKYQMAEYRISIYGRKQSEWDQLASWIVNNELYSENVVWLVQIPRLYNVYKEMGIVTSFQNLLDNIFLPLFEVTIDPASHPQLHVFLKQVVGLDLVDDESKPERRPTKHMPTPEQWTNVFNPAFSYYAYYCYANLYTLNKLRESKGMTTIKFRPHAGEAGDVDHLAATFLLCHNISHGINLRKSPVLQYLYYLGQIGLAMSPLSNNSLFLDYHRNPFPMFFQRGLNVSLSTDDPLQIHLTKEPLVEEYSIAASLWKLSSCDLCEIARNSVYQSGFSHALKAHWIGKNYYKRGPAGNDIHRTNVPHIRVQFRDMIWRNEMKLVYLNNNILISEDLDQ

SEQ ID NO: 6284 - protein, 878 aa, Theobroma cacao
MDTYTVHIAMAALVGASLVAVSAYYMHRKTLSQLLEFAKTVEREREEVSDGESPQHSKKRRGHHSRRKGNGYYRRGSASLPDVTVISGGIDGEEKRNGAIHVDGIPPGLPRLHTLPQGKSGAHATSAKRSSSLIRPTSPKSPVASASAFESIEGSDDEDNMTDNSKIDTTYLHTNGKAGPNLPDHINANGETIQIAASSMIRSHSVSGDLHGVQPDPIAADILRKEPEQETFARLRIAPTEVPSADEVEAYVVLQECLEMRKRYVFKEPVAPWEKEVISDPSTPKPNPEPFFYAPEEKSDHYFEMQDGVIHVYANKDSKEELFPVADATTFFTDLHHILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKQVFSDLAASKYQMAEYRISIYGRKQSEWDQLASWIVNNDLYSENVVWLIQIPRLYNIYKEMGIVTSFQNILDNIFIPLFEVTVDPDSHPHLHVFLKQVVGLDLVDDESKPERRPTKHMPTPDQWTNVFNPAYSYYVYYCYANLYTLNKLRESKGMTTIKFRPHSGEAGDIDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKASALFLLTGSERSTTREDLMEMIYTGQMYLISGWNFVTLSGKRRCSRFIWARPLSLKKWTSNVHHTAQGPFLNITLILGGGKEPAFYLHPG

SEQ ID NO: 6285 - protein, 533 aa, Cichorium intybus
SGYVYAIRFKEKLFPVADATTFFTDLHHILKIIAAGNARTVCHHRLGLLEQKFNLHLMLNADKEFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAEVTSQVFADLEASKYQMAEYRISIYGRKQSEWDNLASWIVNNELYSENVVWLIQLPRLYNIYKEMGIVTSFQTILDNVFLPLFEVTVDPESHPQLHVFLKQVVGLDLVDDESKPERRPTKHMPTPSQWTNIFNPAFSYYVYYCYANLYTLNKLRESKGMTTIRFRPHCGEAGDIDHLAASFLTTHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHVLKSHWIGQEYFKRGPDGNDIHKTNVPHIRLEFRDVIWREEMQQVYLGKANFPQYIET

SEQ ID NO: 6286 - protein, 423 aa, Coffea canephora
EVVIFRDGTYLTLKEVFESLDLSGYDLNVDLLDVHADKSTFHRFDKFNLKYNPCGQSRLREIFLKQENLIQGRFLGELTKQVFSDLEASKYQMAEYRVSIYGRKQSEWDQLASWIVNNDLYSENVVWLIQLPRLYNVYKEMGIVTSFQNILDNVFLPLFEVTVDPDSHPQLHVFLKQVVGFDLVDDESKPERRPTKHMPTPAQWTNIFNPAYSYYIYYCYANLYTLNKLRESKGMTTIKLRPHSGEAGDVDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSSCDICEIARNSVYQSGFSHALKSHWVGKEYYKRGPDGNDIHKTNVPHIRLEFRDMIWREEMQQVYLGNSIFAEHIDP

SEQ ID NO: 6287 - protein, 840 aa, Gossypium hirsutum
MDTYTVHLAMAALVGASLVAVSAYYMHRKTLNQLLEFAKTVEREDISEGESPLPSKKRRAHHSRRKGSGYYRRSSSSLPDVWMMYGGIDGEEKRNGTIHVDGIPPGLPRLHMLPEGKSGGHATPTKKSGSVMRPTSPKSPVASASAFESMEGSEDEDNMTDNSKIDLTYLHTNGNAGPNLPDHINANGEAIQIAASSMIRSHSVSGDLHGVPPDPIAADILRKEPEHETFARLNISPTEVPSPDEVDVYVVLQECLEMRKRYVFKEAVAPWEKEVISDPSTPKPNPAPFFYAPEGKSDHYFEMQDGVIHVYANKDSKEELFPVADATTFFTDLHHILRVIAAGNIRTLCHHRLNLLEQKFNLHLMLNSDREFLAQKSAPHRDFYNVRKVDTHVHHSACMNQKHLLRFIKSKLRKEPDEVVIFRDGTYLTLTEVFESLDLTGYDLNVDLLDVHADKSTFHRFDKFNLKYNPCGQSRLREIFLKQDNLIQGRFLGELTKQVFSDLAASKYQMAEYRISIYGRKQSEWDQLASWIVNNELYSENVVWLIQIPRLYNVYKEMGIVTSFQNILDNIFIPLFEVTVDPDSHPQLHVFLKQVVGLDLVDDESKPERRPTKHMPRPDEWTSVFNPAFSYYAYYCYANLYALNKLRESKGMSTIKFRPHSGEAGDIDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKHYYKRGPDGNDIHKTNVPHIRVEFRDTIWREEMQLVYLGKADIRTDVDK

SEQ ID NO: 6288 - protein, 840 aa, Gossypium hirsutum
MDTYTVHLAMAALVGASLVAVSAYYMHRKTLNQLLEFAKTVEREDISEGESPLPSKKRRAHHSRRKGSGYYRRSSSSLPDVWMMYGGIDGEEKRNGTIHVDGIPPGLPRLHMLPEGKSGGHATPTKKSGSVMRPTSPKSPVASASAFESMEGSEDEDNMTDNSKIDLTYLHTNGNAGPNLPDHINANGEAIQIAASSMIRSHSVSGDLHGVPPDPIAADILRKEPEHETFARLNISPTEVPSPDEVDVYVVLQECLEMRKRYVFKEAVAPWEKEVISDPSTPKPNPAPFFYAPEGKSDHYFEMQDGVIHVYANKDSKEELFPVADATTFFTDLHHILRVIAAGNIRTLCHHRLNLLEQKFNLHLMLNSDREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKQVFSDLAASKYQMAEYRISIYGRKQSEWDQLASWIVNNELYSENVVWLIQIPRLYNVYKEMGIVTSFQNILDNIFIPLFEVTVDPDSHPQLHVFLKQVVGLDLVDDESKPERRPTKHMPRPDEWTSVFNPAFSYYAYYCYANLYALNKLRESKGMSTIKFRPHSGEAGDIDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKHYYKRGPDGNDIHKTNVPHIRVEFRDTIWREEMQLVYLGKADIRTDVDK

SEQ ID NO: 6289 - protein, 845 aa, Cucumis sativus
MDAYPLHMAVAALIGASVVAVSAYYMHRKTLTQLLEFAKTVERDRERDDNNFDAESPRHSKKQRGNYVRRKGTGYNRRASASLPDVTAISGGADGDDKRNGQVLLDVIPAGLPRLHTLPEGKNSTKRSMRPTSPKSPIASTSAFESVEGSDDEDDNMTEDTKLGSGYLLANGNAGPECKGIFENLPDHINANGEQIALAASSMIRSHSISGDLHGVQPDPIAADILRKEPEQETFVRLNITPSEVPLPDEVESYLVLQECLEMRKRYVFSEAVAPWEKEIISDPSTPKPNPDPFQYTSEGKSDHYFEMQDGVIHVYADKDSKEELFPVADATTFFTDLHHILRVTAAGNIRTLCHRRLNLLEQKFNLHLMLNADKEFLAQKSAPHRDFYNVRKVDTHVHHSACMNQKHLLRFIKSKLRKEPDEVVIFRDGTYLTLKEVFESLDLSGYDLNVDLLDVHADKSTFHRFDKFNLKYNPCGQSRLREIFLKQDNLIQGRFLGELTKQVFSDLAASKYQMAEYRISIYGRKQSEWDQLASWIINNDLYSENVVWLIQLPRLYNVYKEMGIVTSFQNILDNIFLPLFEATVDPDSHPQLHVFLKQVVGLDLVDDESKSERRPTKHMPTPAQWTNVFNPAFSYYVYYCYANLYTLNKLRESKGMTTINLRPHSGEAGDIDHLAATFLTAHSIAHGINLRKSPVLQYLYYLAQIGLAMSPLSNNSLFLDYHRNPFPVFFSRGLNVSLSTDDPLQIHFTKEPLVEEYSIAASLWKLSSCDLCEIARNSVYQSGFSHALKSHWIGKEYYKRGPAGNDIHRTNVPHIRVEFRDTIWKEEMQLVYLGKADISDEIEK

SEQ ID NO: 6290 - protein, 833 aa, Medicago truncatula
MDAHAVHLAMAALFGASIVAVSAYYMHRKTLTELLEFARTVEPEGDSDGGERRRGGSKRRNGGGGGYRRGSGSLPDVTAIAGGVEGNGLMHDEGIPVGLPRLQTLRKSANNGSFKRNIIRPTSPKSPVASASAFESVEGSDDEDNLTDTKHDTTYLHTNGNVGGEGKNPYETLPNHVNTNGEQMAITASSMIRSHSISGDLHGVQPDPIAADILRKEPEQEIFARLRITPMEAPSPDEIESYVILQECLEMRKRYIFKEAVAPWEKEVISDPSTPKPNLEPFFYAPEGKSDHYFEMQDGVIHVYPNKNSNEELFPVADATTFFTDLHQILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLREVFESLDLTGYDLNVDLLDVHADKSTFHRFDKFNLKYNPCGQSRLREIFLKQDNLIQGRFLGELTKQVFSDLEASKYQMAEYRISIYGRKQSEWDQLASWIVNNDLYSENVVWLIQLPRLYNIYKDMGIVTSFQNMLDNIFIPLFEVTVDPDSHPQLHVFLKQVVGLDLVDDESKPERRPTKHMPTPAQWTNVFNPAFSYYVYYCYANLYTLNKLRESKGMTTIKFRPHAGEAGDIDHLAATFLTAHNIAHGINLRKSPVLQYLYYLAQIGLAMSPLSNNSLFLDYHRNPLPVFFLRGLNVSLSTDDPLQIHLTKEPLVEEYSIAASVWKLSSCDLCEIARNSVYQSGFSHALKSHWIGKEYYKRGPNGNDIHRTNVPHIRLEFRDTIWREEMQQVYLGKFIIPYEIEK

SEQ ID NO: 6291 - protein, 349 aa, Cucumis melo
RDFYNVRKVDTHVHHSACMNQKHLLRFIKSKLRKEPDEVVIFRDGTYLTLKEVFESLDLSGYDLNVDLLDVHADKSTFHRFDKFNLKYNPCGQSRLREIFLKQDNLIQGRFLGELTKQVFSDLAASKYQMAEYRISIYGRKQSEWDQLASWIINNDLYSENVVWLIQLPRLYNVYKEMGIVTSFQNILDNIFLPLFEVTVDPDSHPQLHVFLKQVVGLDLVDDESKSERRPTKHMPTPAQWTNVFNPAFSYYVYYCYANLYTLNKLRESKGMTTINLRPHSGEAGDIDHLAATFLTAHSIAHGINLRKSPVLQYLYYLAQIGLAMSPLSNNSLFLDYHRNPFPVFFLVV

SEQ ID NO: 6292 - protein, 839 aa, Mimulus guttatus
MDAYPLHLAMAALVGASFVAVSAYYMHRKTLNQLLEFAKAEDGDGDVAEQVNKYPSRRRSKGTAGYSRRGSDVTNVSGGGGDAGDSEERRNGPVHLDYIPAGLPKLHTLPEGKFGSVSSNTRAVHLIRPTSPKSPVGSASASAFESIECSDDEDNMTDNAMLDTTYIHSNGNANLPDHTNVTGEPMPSATSNMVHSHSVTGDLHGVQPDPVAANFLRKEPEQETFVRLRISPLEIPSLEEVDVYRSLQGCLEMRRRYVFREVVAPWEKEIISDPSTPKPIQNPFHHIPEGKSDHYFQMEDGVVHVYANKDSKEKLFPVADATAFFTDLHHILKVIAAGNNRTLCHHRLVLLEQKFNLHLMLNADREFLAQKSAPHRDFYNVRKVDTHVHHSACMNQKHLLRFIKSKLRKEPGEVVIFRDGTYLTLKEVFESLDLTGYDLNVDLLDVHADKSTFHRFDKFNLKYNPCGQSRLREIFLKQDNLIQGRFLAELTKQVFSDLEASKYQMAEYRISIYGRKKSEWDQLASWIVNNDLYSENVVWLIQLPRLYNVYKEMGIVTSFQNILDNIFLPLFEVTVDPDSHPQLHVFLKQVVGLDLVDDESKPERRPTKHMPTPAQWTNIFNPAFSYYAYYCYANLYTLNKLRESKGMTTIKFRPHSGEAGDIDHLAATFLTAHNIAHGINLRKSPVLQYLYYLAQASKKIGLAMSPLSNNSLFLDYHRNPLPMFFLRGLNVSLSTDDPLQIHLTKEPLVEEYSIAASVWKLSSCDLCEIARNSVYQSGFSHALKSHWIGEGYFKHGPDGNDIHKTNVPHIRLEFRDMIWREEMQHVYLGNANFPKFIDP

SEQ ID NO: 6293 - protein, 575 aa, Mimulus guttatus
MTDNIDSTYLHTNGNENATDHINANGEQAPLATPSMIRSHSVSGDLHGVQPDPVAADILRKEPEHESFVQLKISPSEIPSPDEVEVYRTLQDCLEMRKKYVFREAVAPWEKEILSDPSTPKPILNPFDHYPVAKSDHYFRMEDGVVHVYSNKDSKEKLFPVADATTFFTDLHHILKVIAAGNIRTLCHHRLVLLEQKFNLHLMLNADREFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAEVTKQVFSDLETSKYQMAEYRISIYGRKMSEWDQMASWIVNNDLYSENVVWLIQLPRLYNIYKEMGIVTSFQNILDNIFLPLFEVTIDPDSHPQLHVFLKQVVGLDLVDDESKPERRPTKHMPTPAQWTNIFNPAFSYYAYYCYANLYTLNKLRESKGMTTIKFRPHSGEAGDIDHLATTFLTAHNIAHGINLRKSPVLQYLYYLAQANWSCYVSSEQQLLIPRLPSQSVTHVFLTGPQCIPLN

SEQ ID NO: 6294 - protein, 311 aa, Hordeum vulgare
TPLAAKNMTRSHSISNDLHAVQPDPVAADILRKEPEQESFIKLLTAPHEIPSPDEIEVYKILQKCLELRDCYLFREEVAPWEKEVINDPCTPKPNPNPFTFVPEPKSEHVFQMVDGVVQVYADKDCTERIYPVADATTFFTDLHYVLRVTAAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTMQVFF

SEQ ID NO: 6295 - protein, 571 aa, Solanum tuberosum
ACVKEVIFDPCTPKANPNPLEFTPEGKSDHYFQMEDGVVHVYANEDSTENLFPVADATTFFTDFHHILKVIAAGNIRTLCHHRLVLLEQKFNLHLMLNADREFLAQKSAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTKQVFSDLSASKYQMAEYRISIYGRKMSEWDQLASWIVNNELYSENVVWLIQLPRLYNIYKEMGIVTSFQNILDNIFLPLFEVTVDPESHPHLHIFLKQGVGLDLVDDESKPERRPTKHMPTPAQWTNVFNPAFSYYVYYCYANLYTLNKLRESKGMTTIKFRPHSGEAGDIDHLAATFLTSHNIAHGINLRKSPVLQYLYYLAQIGLAMSPLSNNSLFLDYHRNPLPMFFLRGLNVSLSTDDPLQIHLTKEALVEEYSIAASVWKLSACDLCEIARNSVYQSGFSHALKSHWIGKEYYKRGPDGNDIHRTNVPHIRLEFRDMIWREEMQQVYLDKAVFPSFVDP

SEQ ID NO: 6296 - protein, 331 aa, Centaurea maculosa
MAEYRISIYGRKQSEWDNLASWIVNNELYSDNVVWLIQLPRLYNIYKEMGIVTSFQTILDNIFLPLFEVTVDPGSHPQLHVFLKQVVGLDLVDDESKPERRPTKHMPTPAQWTNIFNPAFSYYVYYCYANLYTLNKLRESKGMTTIRFRPHCGEAGDIDHLAAAFLTTHNIAHGINLRKSPVLQYLYYLSQIGLCMSPLSNNSLFLDYHRNPFPMFFLRGLNVSLSTDDPLQIHLTKEPLVEEYSIAASVWKLSACDLCEIARNSVYQSGFSHVLKSHWIGQEYYKRGPDGNDIRKTNVPHIRLEFRDMIWREEMQQIYLGKAILPEYIET

SEQ ID NO: 6297 - protein, 844 aa, Citrus clementina
MDAYTLHLAMAALVGASVVAVSAYYMHRKTLTQLLEFAKSVERERDDNSDAAESPHNVKRHGCAAARRCSSRRKGSGYYRRCSASLPDVTAISGHAVDGEERRNGPLHVDGIPAGLPRLHTLPEGKSAGHASSTKRAGNLIRPTSPKSPVASAFESVEGSDEEDNMTDSSKLDTTYLLTNGNAGPNLPDHMNVNAEAIAASSMIRSHSVSGDLHGVQPDPIAADILRKEPEQETFARLQITPKEVPSPDEMEAYVVLQECLEMRKRYLFREAVAPWEKEMISDPSTPKPNPDPFYYAPVGKSDHHFEMQDGVIHVYPNKDSKEELYPVADATTFFTDLHHILRVIALGNMRTLCHHRLLLLEQKFNLHLMLNADKEFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKQVFSDLEASKYQMAEYRISIYGRKQSEWDQLASWIVNNELYSENVVWLIQLPRLYNIYKDMGIVTSFQNILDNIFIPLFEVTVDPDSHPQLHVFLKQVVGLDLVDDESKPERRPTKHMPTPAQWTNVFNPAFSYYAYYCYANLYTLNKLRESKGMTTIKFRPHAGEAGDIDHLAATFLTAHNIAHGINLRKSPVLQYLYYLAQIGLAMSPLSNNSLFLDYHRNPLPMFFLRGLNVSLSTDDPLQIHLTKEPLVEEYSIAASVWKLSACDLCEIARNSVYQSGFSHALKSHWIGLHYYKRGPDGNDIHKTNVPHIRIEFRDTIWREELQQVYLGKAIIPEELL

SEQ ID NO: 6298 - protein, 381 aa, Zostera marina
MDEYAVHLAIAAIAGASVVAISAYFMHRKTLAQILEFARSMEKERDRVKEKDAKENSTLLEESAGNAGGMYHYKRRNHLSRRRIAIGRTSASLPDVTVARKMNGTEGEERGIGSDAEVVSTEMVFKDDDDDDDDDYYKGMGVPPGLPKVQTFPKVSNSIKRIVGHVTKESSPKSPATCTSTFDSLEGSDDEDNVENNAEIHGSYLEADENAEDTECNTFIQTMPDHIDANGNPIPLGSANIIRSHSKSGDLHGVQPDPIAADILRKEPEHETFIRLKITPNEIPSMDEAEAYMVLQECLQLREDYLFMEEVAPWEKEVITDPSTPKANPNPFSYTSEKKTDHYFQMEDGVVQVYANKSSKDKLFNVVDATTFLPICIVFFV

SEQ ID NO: 6299 - protein, 695 aa, Panicum virgatum
STRRRRPRAPAGAAGGKPPPTRRAGGGSASLPDLSAFYDGVGRGGGGGGLAGGGYLVEEEEEEGLVGPHANGGALDPADLLQIPQGLPRLHVGADGNKQLARSGSNRRVAVIRPNSPKSPAASASAFESVDGSDEDDATQHGGKLDNGYINTNGNLEGERKGNASVENGTSKPSVANLIRSHSISNDLHAVQPDPVAADILRREPEQESFIKLLTAPKEIPTPDEIEVFKILQKCLELRDSYLYREEVAPWEKEIINDPCTPKPNPNPFTYVPEPKSEYVFQMVDGVVHVYEDKNYTERIYPVADATTFFTDLHYILRVTAAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTKQVFSDLSASKYQMAEYRISIYGRKQSEWDQLASWIVNNELYSENVVWLVQIPRLYNVYKEMGIVTSFQNLLDNIFLPLFEVTIDPASHPQLHVFLKQVVGLDLVDDESKPERRPTKHMPTPEQWTNVFNPAFSYYAYYCYANLYTLNKLREAKGMTTIKFRPHAGEAGDVDHLAATFLLCHNISHGINLKEVSGASVLVLSWSDWSGNVPIEQQLIVS

SEQ ID NO: 6300 - protein, 856 aa, Aquilegia formosa
MESYYGIHMAMAALVGASFVAVSAYYMHRKTLTQLLDFAKTIEQQRQRRERYTGFDDDDDDEEEEEVEEQYININNYIQNRRRNNGERRQYHSISNSLTDSRLITNFEDKEDRNLPIPVGLPPLRKFPEGHSFRSASSVKRGHVVRPISPRSPVASASAFGSVEGSDDEDDFTVDNNIETGELYGNGNEGTEYKSVYPHADTNVDQNSADAARMSNSHSVSGNIHGVQPYPVAADILRKEPEHETVVQLRINPTEVPSPDQVEAYQMLQECLELRQSYVFMEEVAPWEKEVITDPSTPKPNLNPFSYSHEGKTDHHFQMEDGVVHVYANKNSTEKLFPVADATTFFTDLHHILRVTAAGNIRSLCHHRLVLLEQKFNLHLMLNADREFLAQKGAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKQVFSDLDASKYQMAEYRISIYGRKQSEWDQLASWIINNDLYSENVVWLIQLPRLYNVYKGMGIVTSFQNMLDNIFLPLFEVTVDPDSHPQLHVILKQVVGLDLVDDESKPERRPTKHMPTPAQWTNFFNPAFSYYAYYCYANLYTLNKLRESKGMTTIKFRPHAGEAGDIDHLAATFLTAQNIAHGINLRKSPVLQYLYYLAQIGLAMSPLSNNSLFLDYHRNPFPMFFLRGLNVSLSTDDPLQIHLTKEPLVEEYSVAASVWKLSSCDMCEIARNSVYQSGFSHALKAHWIGKSYYKRGPEGNDIHKTNVPHVRIEFRYAIWREEMQQVYLGKANIPDNIDQ

SEQ ID NO: 6301 - protein, 342 aa, Cichorium intybus
GDLMRIRIFSSKSAPHRDFYNARKVDTHVHHSACMNQKHLLRFIKSKLRKEPDEVVIFRDGTYLTLREVFESLDLTGYDLNVDLLDVHADKSTFHRFDKFNLKYNPCGQSRLREIFLKQDNLIQGRFLAELTKQVFADLDASKYQMAEYRISIYGRKQSEWDNLASWIVNNELYSDNVVWLIQLPRLYNIYKEMGIVTSFQTILDNIFLPLFEVTVDPGSHPQLHVFLKQVVGLDLVDDESKPERRPTKHMPTPSQWTNIFNPAFSYYVYYCYANLYTLNKLRESKGMTTIRFRPHCGEAGDIDHLAAAFLTTHNIAHGNLRKSPVLQYLYSSHRLVLPCHH

SEQ ID NO: 6302 - protein, 850 aa, Eucalyptus grandis
MDAYSLHLAMAALVGASFVAVSAYYMHRKTLNQLLEFAKTVERERERGDDDSEEESPQNLRRRRGGGGGGSRRRGGAYRRASASLPDVTAMSGDGGGMDGDERCNGPIALDGIPAGLPRLQTLHEGKSAPLSSSVKRVGSLIRPTSPKSPVASASAFESLEGSDDENDMTDNSKLDPTYLLTNGNAGPDGKTSLPNGEQIPMAAASMIRSHSVSGDLHGVQPDPIAADILRKEPEHETFVRLKISPNEVPASDEVESYLILQECLELRRRYVFRESIAPWEKEVISDPSTPKPNPAPFSYTSVGKSDHHFEMQDGVVHVYPDKESKEELFPVADATTFFTDLHTILRVIALGNVRTLCHRRLVLLEQKFNLHLMLNADGEFIAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTQQVFSDLEASKYQMAEYRISIYGRKMSEWDQLASWIVNNELYSENVVWLIQLPRLYNIYKEMGIVTSFQNILDNIFIPLFEVTIDPDSHPQLHVFLKQVVGLDLVDDESKPERRPTKHMPTPAQWTNVFNPAFSYYAYYCYANLYTLNKLRELKGMTTIRFRPHSGEAGDIDHLAATFLTSHNIAHGINLRKSPVLQYLYFLSQIGLAMSPLSNNSLFLDYHRNPFQMFFQRGLNVSLSTDDPLQIHLTKEPLVEEYSIAASVWKLSSCDLCEIARNSVLQSGFSHALKSHWIGKGYYKRGADGNDIRKTNVPHIRIEFRDMIWREEMQQVYAGSANFPEELDIK

SEQ ID NO: 6303 - protein, 289 aa, Helianthus annuus
MEDGVVHVYANKDSKEKLFPVVDATTFFTDLHHLLKVIAAGNTRTVCHHRLGLLEQKFNLHLMLNADKEFLAQKSAPHRDFYNVRKVDTHVHHSACMNQKHLLRFIKSKLRKEPDEVVIFRDGTYLTLREVFESLDLTSYDLNVDLLDVHADKSTFHRFDKFNLKYNPCGQSRLREIFLKQDNLIQGRFLAELTKQVFTDLDASKYQMAEYRISIYGRKQSEWDNLASWIVNNELYSDNVVWLIQLPRLYNIYKEMGIVTSFQTILDIYSFLFSRLQLTQDHIRSCMFS

SEQ ID NO: 6304 - protein, 535 aa, Citrus sinensis
MELFMVYPNKDSKEELYPVADATTFFTDLHHILRVIALGNMRTLCHHRLLLLEQKFNLHLMLNADKEFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKQVFSDLEASKYQMAEYRISIYGRKQSEWDQLASWIVNNELYSENVVWLIQLPRLYNIYKDMGIVTSFQNILDNIFIPLFEVTVDPDSHPQLHVFLKQVVGLDLVDDESKPERRPTKHMPTPAQWTNVFNPAFSYYAYYCYANLYTLNKLRESKGLTTIKFRPHAGEAGDIDHLAATFLTAHNIAHGINLRKSPVLQYLYYLAQIGLAMSPLSNNSLFLDYHRNPLPMFFLRGLNVSLSTDDPLQIHLTKEPLVEEYSIAASVWKLSACDLCEIARNSVYQSGFSHALKSHWIGLHYYKRGPDGNDIHKTNVPHIRIEFRDTIWREELQQVYLGKAIIPEELL

SEQ ID NO: 6305 - protein, 869 aa, Zea mays
MDSSGSASSYKLQLALAALVGASAAASAAYYLHCRAVAQVARSASTSRRRPRAPASAASGGGGGGVKLPPPRRAAVGSASLPDLSAFYDVGSRGGGGLAAGGYLVEEEEDDDADGVVGPHVNGGALDPAEFLQIPQGLPRLHVGPDGSKQLARSGSNRRVEIIRPKSPKSPAASASEDGSDEDDSIQSSGKLDNGYMDTSGNLEGEHKGNAIVENGAAKPLAAANLIRSRSKSNNLHAVQPDPVAADILRKEPQQESFVKLLTTPKEIPTADEIEVFKILQKCLELRDSYLFREEVAPWEKEVINDPCTPKPNPNPFTYVPEPKSEHVFQTVDGVIHVYADKDCTESIYPVADATTFFTDLHYILRVTAAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTKQVFSDLSASKYQMAEYRISIYGRKQSEWDQLASWIVNNELHSGNVVWLVQIPRLYNVYKEMGIVTSFQNLLDNIFVPLFEVTIDPASHPQLHVFLKQVVGLDLVDDESKPERRPTKHMPTPEQWTNVFNPAFSYYAYYCYANLFTLNKLRESKGMTTIKFRPHAGEAGDVDHLAATFLLCHNISHGINLRKSPVLQYLYYLGQIGLAMSPLSNNSLFLDYHRNPFPTFFQRGLNVSLSTDDPLQIHLTKEPLVEEYSIAASLWKLSSCDLCEIARNSVYQSGFSHALKAHWIGKNYFKRGPAGNDIHRTNVPHIRVQFREMIWRNEMKLVYSDNEILIPDELDL

SEQ ID NO: 6306 - protein, 864 aa, Tabernaemontana elegans
MDTYALHLAMAALVGASVVAVSAYYMHRKTLNQLLEFAKTIEREREREDFAEEGGGGGGGDSPQHLRRCGSVEKRRNHSRRKGNGYYRRGSASLPDVTAISGAADVVEEKRNGPVRVDSIPAGLPRLHTLPEGKSGHTSSTKRAGHLIRPTSPKSPVASASAFESMEGSDDEDNMTDSAKLDTAYIHTNGNVGPECESMFQNLPNHMNADNGEQMAMAASSMIRSHSVSGDLHSVQPDPVAADILRKEPEQETFVRLRISPMEVPSADEAEVYRNLQDCLELRRSYVFREAVSPWEKEIISDPSTPKPNPNPFDFIPEGKSDHHFQMEDGVVQVYANKDSKEKLFPVADATTFFTDLHHILKVIAAGNIRTLCHHRLVLLEQKFNLHLMLNADREFLAQKSAPHRDFYNVRKVDTHVHHSACMNQKHLLRFIKSKLRKEPDEVVIFRDGTYLTLKEVFESLDLSGYDLNVDLLDVHADKSTFHRFDKFNLKYNPCGQSRLREIFLKQDNLIQGRFLGELTKQVFSDLVASKYQMAEYRVSIYGRKQSEWDQLASWIVNNDLYSENVVWLIQLPRLYNIYKEMGIVTSFQNILDNVFIPLFEVTVDPDSHPQLHVFLKQVVGFDLVDDESKPERRPTKHMPTPAQWTNIFNPAFSYYAYYCYANLYTLNKLRESKGMTTIKFRPHSGEAGDIDHLAATFLTAHNIAHGINLRKSPVLQYLYYLAQIGLAMSPLSNNSLFLDYHRNPFPVFFLRGLNVSLSTDDPLQIHLTKEPLVEEYSIAASVWKLSACDLCEIARNSVYQSGFSHALKSHWVGKEYYKRGPDGNDIHKTNVPHIRLEFRDMIWREEMQQVYLGKAIFPEHVDP

SEQ ID NO: 6307 - protein, 485 aa, Brassica napus
LEQKFNLHLMLNADKEFLAQKSAPHRDFYNVRKVDTHVHHSACMNQKHLLRFIKSKLRKEPDEVVIFRDGTYLTLKEVFESLDLTGYDLNVDLMDVHADKSTFHRFDKFNLKYNPCGQSRLREIFLKQDNLIQGRFLGEITKQVFSDLEASKYQMAEYRISIYGRKMSEWDQLASWIVNNDLYSENVVWLIQLPRLYNIYKDMGIVTSFQNILDNIFIPLFEATVDPDSHPQLHVFLKQVVGFDLVDDESKPERRPTKHMPTPAQWTNAFNPAFSYYVYYCYANLYVLNKLRESKGMTTITLRPHSGEAGDIDHLAATFLTCHSIAHGINLRKSPVLQYLYYLAQIGLAMSPLSNNSLFLDYHRNPFPVFFLRGLNVSLSTDDPLQIHLTKEPLVEEYSIAASVWKLSSCDLCEIARNSVYQSGFSHALKSHWIGKDYYKRGPDGNDIHKTNVPHIRVEFRDTIWKEEMQQVYLGKAVISDEVVP

SEQ ID NO: 6308 - protein, 866 aa, Sorghum bicolor
MDSSGSASSYKLQLALAALVGASSAAVAAYYLHYRAVAQVARSASTNRRRTRPPTPAPAASGRKLPPPRRDAVGSASLPDLSAFYDAGGHGGGGLASSGYLVEEEEEDDAHGVVGPHANGGALEHAELLDIPQGLPRLNVGPDGSKPFARTVSTRRVEIIRPKSPKSPAASASALESADGSGDAIQNSDNGYMNTNGNLEGEHKGNAIVENGAAKPLAAASLMRSKSISNGLHAVQPDPVAADILRKEAQQESFIKMLTTPEEIPTADEIEVFKILQKCLELRDSYLFREEVTPWEKEAINDPCTPKPNPNPFTYVPEPKSEHVFQMVDGVVHVYADKDCTESIYPVADATTFFTDLHYILRVTAAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTKQVFSDLSASKYQLAEYRISIYGRKQSEWDQLASWIVNNELHNENVVWLVQIPRLYNVYKGMGIVTSFQNLLDNIFLPLFEVTIDPASHPQLHVFLKQVVGLDLVDDESKPERRPTKHHMPTPEQWTNVFNPAFSYYAYYCYANLFTLNKLRESKGMTTIKFRPHAGEAGDIDHLAATFLLCHNISHGINLRKSPVLQYLYYLGQIGLAMSPLSNNSLFLDYHRNPFPTFFQRGLNVSLSTDDPLQIHLTKEPLVEEYSIAASLWKLSSCDLCEIARNSVYQSGFSHAQKSHWIGKNYFKRGLAGNDIHRTNVPHIRVQFREMIWRNEMKLVYSDNEILIPDELDL

SEQ ID NO: 6309 - protein, 838 aa, Arabidopsis lyrata
MEPNIYQLALAALFGASFVAVSGFFMHFKALNLVLERGKERKENPEGDEPQNPTLVRRRSQVRRKGIDQYGRSPASLPDATPFTDGGGGDTGRSNGHVYVDEIPPGLPRLHTPSEGRASVHGASSIRKTGSFVRPISPKSPVASASAFESVEESDDDDNLTNTEGLDASYLQANGDNELPVDANEEQISMAASSMIRSHSVSGDLHGVQPDPIAADILRKEPEQETFVRLNVPLEVPTSDEVEAYKCLQECLELRKRYVFQETVAPWEKEVISDPSTPKPNTEPFAHYPQGKSDHYFEMQDGVVHVFANKDTKEELFPVADATAFFTDLHHVLKVIAAGNIRTLCHRRLVLLEQARKFNLHLMLNADKEFLAQKSAPHRDFYNVRKVDTHVHHSACMNQKHLLRFIKSKLRKEPDEVVIFRDGTYLTLREVFESLDLTGYDLNVDLLDVHADKSTFHRFDKFNLKYNPCGQSRLREIFLKQDNLIQGRFLGEITKQVFSDLEASKYQMAEYRISIYGRKMSEWDQLASWIVNNDLYSENVVWLIQLPRLYNIYKDMGIVTSFQNILDNIFIPLFEATVDPDSHPQLHVFLKQVVGFDLVDDESKPERRPTKHMPTPAQWTNAFNPAFSYYVYYCYANLYVLNKLRESKGMTTITLRPHSGEAGDIDHLAATFLTCHSIAHGINLRKSPVLQYLYYLAQIGLAMSPLSNNSLFLDYHRNPFPVFFLRGLNVSLSTDDPLQIHLTKEPLVEEYSIAASVWKLSACDLCEIARNSVYQSGFSHALKSHWIGKDYYKRGPDGNDIHKTNVPHIRVEFRDTIWKEEMQQVYLGKAIISDEVVP

SEQ ID NO: 6310 - protein, 839 aa, Arabidopsis thaliana
MEPNIYQLALAALFGASFVAVSGFFMHFKALNLVLERGKERKENPDGDEPQNPTLVRRRSQVRRKVNDQYGRSPASLPDATPFTDGGGGGGGDTGRSNGHVYVDEIPPGLPRLHTPSEGRASVHGASSIRKTGSFVRPISPKSPVASASAFESVEESDDDDNLTNSEGLDASYLQANGDNEMPADANEEQISMAASSMIRSHSVSGDLHGVQPDPIAADILRKEPEQETFVRLNVPLEVPTSDEVEAYKCLQECLELRKRYVFQETVAPWEKEVISDPSTPKPNTEPFAHYPQGKSDHCFEMQDGVVHVFANKDAKEDLFPVADATAFFTDLHHVLKVIAAGNIRTLCHRRLVLLEQKFNLHLMLNADKEFLAQKSAPHRDFYNVRKVDTHVHHSACMNQKHLLRFIKSKLRKEPDEVVIFRDGTYLTLREVFESLDLTGYDLNVDLLDVHADKSTFHRFDKFNLKYNPCGQSRLREIFLKQDNLIQGRFLGEITKQVFSDLEASKYQMAEYRISIYGRKMSEWDQLASWIVNNDLYSENVVWLIQLPRLYNIYKDMGIVTSFQNILDNIFIPLFEATVDPDSHPQLHVFLKQVVGFDLVDDESKPERRPTKHMPTPAQWTNAFNPAFSYYVYYCYANLYVLNKLRESKGMTTITLRPHSGEAGDIDHLAATFLTCHSIAHGINLRKSPVLQYLYYLAQIGLAMSPLSNNSLFLDYHRNPFPVFFLRGLNVSLSTDDPLQIHLTKEPLVEEYSIAASVWKLSACDLCEIARNSVYQSGFSHALKSHWIGKDYYKRGPDGNDIHKTNVPHIRVEFRDTIWKEEMQQVYLGKAVISDEVVP

SEQ ID NO: 6311 - protein, 577 aa, Brassica rapa
FQETVAPWEKEVISDPSTPKPNLEPFAHYPQGKSDHHFEMLDGVVHVFPNKDVKEELFPVADATAFFTDLHHVLKVIAAGNMRTLCHRRLVLLEQKFNLHLMLNADKEFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGEITKQVFSDLEASKYQMAEYRISIYGRKMSEWDQLASWIVNNDLYSENVVWLIQLPRLYNIYKDMGIVTSFQNILDNIFIPLFEATVDPDSHPQLHVFLKQVVGFDLVDDESKPERRPTKHMPTPAQWTNAFNPAFSYYVYYCYANLYVLNKLRESKGMTTITLRPHSGEAGDIDHLAATFLTCHSIAHGINLRKSPVLQYLYYLAQIGLAMSPLTNNSLFLDYHRNPFPVFFLRGLNVSLSTDDPLQIHLTKEPLVEEYSIAASVWKLSSCDLCEIARNSVYQSGFSHALKSHWIGKDYYKRGPDGNDIHKTNVPHIRVEFRDTIWKEEMQQVYLGKAVISDEVVP

SEQ ID NO: 6312 - protein, 676 aa, Triphysaria pusilla
ANLERSYLRFHGKTKVPDHINANSESTALATPSMIRSHSVSGDLHGVQPDPVAADILRKEPEQESFVRLRISPNEIPSPDEVEVYRTLQVCLEMRKTYVFKEAVSPWEKEIISNPSTPKRVLNPFDHTPEAKSEHYFQMEDGVVQVYSNKNSKEKLFSVADATTFFTDLHHILKVIAAGNIRTLCHHRLVLLEQKFNLHLMLNADKEFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKQVFTDLETSKYQMAEYRISIYGRKMSEWDQLASWIVNNDLYSDNVVWLVQLPRLYNIYKDMGIVTSFQNILDNIFLPLFEVTVDPDSHPQLHVILKQVVGLDLVDDESKPERRPTKHMPTPAQWTNIFNPAFSYYAYYCYANLYTLNKLRESKGMSTIKFRPHSGEAGDIDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWIGKEYFERGPDGNDIHKTNVPHIRLEFRDMIWREEMHQVYLGKANFPKFIDP

SEQ ID NO: 6313 - protein, 79 aa, Cucurbita pepo
LKYNPCGQSRLREIFLKQDNLIQGRFLGEVTKQVFSDLGASKYQMAEYRISIYGRKQSEWDQLASWIINNDLYSEMSCG

SEQ ID NO: 6314 - protein, 258 aa, Lactuca sativa
VRKVDTHVHHSACMNQKHLLRFIKSKLRKEPNEVVIFRDGTYLTLKEVFESLDLTGYDLNVDLLDVHADKSTFHRFDKFNLKYNPCGQSRLREIFLKQDNLIQGRFLAEVTSQVFADLEASKYQMAEYRISIYGRKQSEWDNLASWIVNNELYSENVVWLIQLPRLYNIYKEMGIVTSFQTILDNVFLPLFEVTIDPDSHPQLHVFLKQVVGLDLVDDESKPERRPIKHMPTLFPLLKTSSILHSHTMSIIVMPIFIP

SEQ ID NO: 6315 - protein, 892 aa, Distylium racemosum
MDFGTSQALHLVMAALVGATVVAASAYYMHKRTLDQLLEYRRRIDGEETEEEEGEGEPARGKRRRRQNGRKLGREAARYSRFSSSMPDFATVEGGGLEYYYGNGENNNNEDEVNRYKKWSNYSINEAENERRGSYGNLTMIPSGLPSLETRRDGSRQSLNQLASTKRVPVLTPKSPNVTNGGAFESMEGSDEEDETHDNQGEQNYAYEDGDTVTENLTAIPEDGKPVSSSGLDHAGMNGEQNQMTASSIMRSHSVSGDLHGVHATDPVAANILRKEPEQETFVRLNITPIEAPSTEEEEVCCMLQECLEMRDKYVFREKVAPWKKEIITDPSTPRPNPDPFLYESEEKTEHHFRMEDGVVQVYANKDATEPLFPVPDATKFFTDLHRILKIIAVGNVRTLCHHRLRLLEQKFSLHLMLNADREFLAQKSAPHRDFYNVRKVDTHVHHSSCMNQKHLLRFIKSKLRKEPDEVVIYRDGIYLTLKEVFESLDLTGYDLNVDLLDVHADKNTFHRFDKFNLKYNPCGQSRLREIFLKQDNLIQGRFLAEITKQVFSDLAASKYQMAEYRISIYGRKQSEWDQMASWIVNNELYSENVVWLIQLPRLYNVYKDMGIVMTFQNMLDNIFIPLFEVTVDPNSHPQLHVFLKQVVGFDMVDDESKPERRPTKHMPTPEQWNNVFNPAYSYYAYYCYANLYVLNKLRESKGYSILKFRPHCGEAGDIDHLAATFLLAHNIAHGNNLRKSPALQYLYYLSQIGLAMSPLSNNSLFLDYHRNPFPMFFARGLNVSLSTDDPLQIHLTKEPLVEEYSIAASVWKLSACDLCEIARNSVYQSGFSHALKSHWIGRNYYKRGPAGNDIHRTNVPHMRVEFRDEVWKEEMQYLYLGSAPIPKEVVP

SEQ ID NO: 6316 - protein, 279 aa, Raphanus sativus
  misc_feature (33)..(33): Xaa can be any naturally occurring amino acid
  misc_feature (278)..(278): Xaa can be any naturally occurring amino acid
NKDAKEELFPVADATAFFTDLHHVLKVIAAGNXRTLCHRRLVLLEQKFNLHLMLNADKEFLAQKSAPHRDFYNVRKVDTHVHHSACMNQKHLLRFIKSKLRKEPDEVVIFRDGTYLTLKEVFESLDLTGYDLNVDLMDVHADKSTFHRFDKFNLKYNPCGQSRLREIFLKQDNLIQGRFLGEITKQVFSDLEASKYQMAEYRISIYGRKMSEWDQLASWIVNNDLYSENVVWLIQLPRLYNIYKDMGIVTSFQNILDNIFIPLFEATVDPDSHPSSMXF

SEQ ID NO: 6317 - protein, 362 aa, Conyza canadensis
IFLKQDNLIQGRFLAELTQQVFTDLEASKYQMAEYRISIYGRKQSEWDNLASWIVNNELYSENVVWLIQLPRLYNIYKGMGIVSSFQTILDNIFLPLFEVTIDPGSHPQLHVFLKQVVGLDLVDDESKPERRPTKHMPTPEQWNNVHNPAFAYYVYYCYANLYTLNKLRESKGMNTIRFRPHCGEAGDIDHLAASFLTTHSISHGINLRKSPVLQYLYYLSQIGLAMSPLSNNSLFLDYHRNPFPIFFARGLNVSLSTDDPLQIHLTKEPLVEEYSIAASVWKLSSCDLCEIARNSVYQSGFSHAQKSHWIGQEYYKTGPDGNDIRKTNVPRIRLEFRDMVWKEEMQQVYLGKPYIPEHIES

SEQ ID NO: 6318 - protein, 538 aa, Vinca minor
MEDGVVQIYANKDSKEKLFPVADATTFFTDLHHILKVIAAGNIRTLCHHRLVLLEQKFNLHLMLNADKEFLAQKSAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLGELTKQVFSDLAASKYQMAEYRVSIYGRKQSEWDQLASWIINNDLYSENVVWLIQLPRLYNIYMEMGIVTSFQNILDNVFIPLFEATVDPDSHPQLHVFLKQVVGFDLVDDESKPERRPTKHMPTPAQWTNIFNPAFSYYAYYCYANLYTLNKLRESKGMTTIKFRPHSGEAGDIDHLAATFLTAHNIAHGINLRKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKSHWVGKAYNMRGPDGNDIRKTNVPHIRLEFRDTIWREEMQQVYLGKASFPQFVDP

SEQ ID NO: 6319 - protein, 283 aa, Cenchrus ciliaris
  misc_feature (197)..(197): Xaa can be any naturally occurring amino acid
MAEYRISIYGRKKSEWDQMASWIVNNELYSENVVWLIQIPRIYNIYREMGTINSFQNLLDNIFLPLYEVTIDPASHPQLHVFLEQVVGLDLVDDESKPERRPTKHMPTPEQWTNVFNPAYAYYVYYCYANLYTLNKLRESKGMTTIKLRPHCGEAGDIDHLAAAFLTSHNIAHGVNLRKSPVLQYLYYLAQIGLAMXPLSNNSLFIDYHRNPFPTFFLRGLNVSFSTDDPLQIHLTKEPLVEEYSIAASLWKLSSCDLCEIARNFVYQSGFFHRLKFHWIGRK

SEQ ID NO: 6320 - protein, 437 aa, Pseudotsuga menziesii
LLRFIKSKLKKEPDEVVIFRDGKYLTLKEVFESLDLTGYDLNVDLLDVHADKNTFHRFDKFNLKYNPCGQSRLREIFLKQDNLIQGRFLAELTKQVLSDLEASKYQMAEYRISVYGRKQSEWDQLASWFVNNEIYSENAIWLIQFPRLYNVYKGMGIVLSFQNILDNIFIPLFEVTVDPGSHPQLHVFLKQVVGFDMVDDESKPERRPTKHMPTPEQWTNDFNPAFSYYAYYCYANLYTLNKLRESKGMTTIKFRPHCGEAGDIDHLAAAFLLTHNIAHGNNLRKSPALQYLYYLSQIGLAMSPLSNNSLFLDYHRNPFPMFFARGLNVSLSTDDPLQIHLTKEPLVEEYSVAAQVWKLSACDLCEIARNSVYQSGFSHACKSHWVGRKYYIRGPEGNDIHRTNVPHMRVEFRHEVWKEERQYLYLGQAKIPRESDP

SEQ ID NO: 6321 - protein, 618 aa, Triticum aestivum
CQVKSVSSLGGAGYRVSREDGSEETYDSVILGVHAPNALKVLGLEATNRERRILGACQYVLLDIYLHSDQNLMPRNSSAWSAWNFLGTSSRVFSVTYWLNQIQKIESVRPFLVTLNPPCVPDHVLLKWNTSLPVPSVAAAKAYLQLDQIQGKRGIWFCGVYNGHGFHEDGLKSGKAAAQGLLGKKCDVLLNPKKMSPSWTEAGARLLVIRFFNQYVSIGNLILVEEGGSVFSFGKACDKCCVKSVIQVHDPLFYWKVAIEGGMGLAEAYIDGCYSVLDKREGLLNLILILIANRDERRNRRIARKGFWLSPFHVIAQLAYAKHFLRETSRKNTATQTRRNISQHYDLSNDFFSLFLDKSMTYSCAVFKDNESLEAAQQRKLSLLINKAKVKRGHHVLDIGSGWGSLALETVKQTGCKYTGVTLSAEQHKYAERKVREAGLEDRINFLLCDYRKIPPFKYDAIISCGMIEHVGHGYMNEFFACCESYLAEDGILVLQFISVPEERYEQYRKRPDFIKEYIFPGGCLPSLARIMSAMTTSSRFCIEHVENIGPNYYTTLMHWRDNFMANKDEVLALGFDERFLRIWEYYLIFSAAGFKSRAFGDYQVVFSRPGNRRLGQP

SEQ ID NO: 6322 - protein, 472 aa, Triticum aestivum
QIQGKREIWSCGSYQGHGFHEDGLMAGKAAAQGLLGKKCELLLYPKQIIPSWTVAGARLAFARFFMQYISIGNLILVEAGGSVFSFGKACNKCHVKSVVRVHDPLFYWKATTEGEIGLGEAYINGYFSCLDKREGLLNLILILIANRDERKSRGIARKRRWGSPLHVIARLSYAKYVLRHASRKNTAAQTRRNISQHYDLSNDFFSLFLDKSMTYSCAVFKMENESLEAAQQRKLSLLIDKAKVEREHHVLDIGSGWGSLAIQVVKQTGCKYTGVTLSEEQLKYAESKVREAGLEDHITFLLCDYRLIPPYKYDAIISCGMIEHVGHEYMDEFFACCESYLAEDGILVLQFISIAEERYEQYRRRPHFVKEYIFPGGCIPSLARVMSAMTTSSRFSIEHVENIGPNYYTTLMHWRDNFMANKDQVLELGFDEKFIRIWEFYLIYSAAGFKSRAVGDYQVVFSRPGNRRLGLP

SEQ ID NO: 6323 - protein, 584 aa, Triticum aestivum
KVLGAEATHHERRILGACQYVHRDIYLHYDQNLMPRNSSAWSACNFMGTTSSGFSVTYWLNHIQKIGPVRTFLVTLNPPRVPDNVLLKWSTSLPVPSVAAAKAYLQLDQIQGKRGIWFCGAYQGHGFHEDGLKAGKAVAQGLLGKKCELLLNPKQMIPSWTEAGARLLVASFFNLYISIGNLILVEEGGSVFSFGKACDKCHVKSVMRVHDPLFYWKIATEGNLGLAEAYINGCFSFLDKREGLLNLILILIANRDDRRNRRIARKGGRWTPLHVLGRLAHAKYFLGKFSRKNTVTRSRRNVSQHYDLSNEFFSLFMDKSMTYSCAIFKMENESLEAAQERKLRLLINKAKVERGHHVLDIGFGWGSLAIQVVKQTGCKYTGVTLSEEQLKYAQGKAREAGLEDHITFLLCDYRHIPPYKYDAIISICMIEHVGHECMDEFFACCESYLAEDGIMALQFISAPEERYEQYRKRPDFLTEYIFPGGCLPSLARVVSAMSTSSRFSIEHVENIGPNYYPTLMCWMDNFTANKDKMLALGFDEKFIRIWEYYLIFSAACMKSRTLGVYQVVFSRPGNRRLGQPLAKA

SEQ ID NO: 6324 - protein, 393 aa, Triticum aestivum
FSFGKACDKCRVKSVMRVHDPLFYWKIATEGNLGLAEAYINGCFSFLDKREGLLNLILILIANRDDRRNRRIARKGGRWTPLHVLGRLAHAKYFLGKFSRKNTVTRSRRNVSQHYDLSNEFFSLFMDKSMTYSCAIFKMENESLEAAQERKLRLLINKAKVERGHHVLDIGFGWGSLAIQVVKQTGCKYTGVTLSEEQLKYAQGKAREAGLEDHITFLLCDYRHIPPYKYDAIISICMIEHVGHECMDEFFACCESYLAEDGIMALQFISAPEERYEQYRKRPDFLTEYIFPGGCLPSLARVVSAMSTSSRFCIEHVENIGPNYYPTLMCWMDNFTANKDKMLALGFDEKFIRIWEYYLIFSAACMKSRTLGVYQVVFSRPGNRRLGQPLAKA

SEQ ID NO: 6325 - protein, 310 aa, Triticum aestivum
HSSSTPPLPARRRRPQPLPDVPLLRICTAGELLAPREVHIWYLCPDELKNQSQLNMYEELLSPSEREYADSMKATMLRKDAVLSRALLRTTLSRYTGYKIDPRSFEFKKNKFGKPEVLWPHDDSTAEQPLHFNISHTTSLIACGIAINARIGIDIEEKKRNTTKNISSLARRYFTPSEVNYLSEVSDSDAQRKEFLKLWTLKEAYVKALGMGFSGAPFSTFSIMLNTSKGIRISKALNDSRTGCDHLSENWLFTLAELNSSHYMSVCIEDSSRSQGPEDSPAPVGLKVWKTIPFVEDTLVSGTEAVKLIA

SEQ ID NO: 6326 - protein, 90 aa, Triticum aestivum
GFNMLNTSKGIRISKALNDSRTGCDHLSENWLFTLAELNSSHYMSVCIEDSSRSQGPEDSPAPVGLKVWKTIPFVEDTLVSGTEAVKLIA

SEQ ID NO: 6327 - protein, 187 aa, Avena sativa
SSETSMRGDHVRDLLAGEKKLMTVARTARRRRLELRGLGRTASAAAEDEAAKRVRAAPDSSSDSCDSSARVAPDNAVVVARCPTCVSYGAVSVIGRRREMEDAVAVAPCFLAEKAVVEGGSSGDAEHVDGEEEGFFAVYDGHGGSRVAEACRERMHVVLAEEVRLRRRGDDKAGPRTARTARGGRRP

SEQ ID NO: 6328 - protein, 357 aa, Triticum aestivum
MAIRNKEGGTVIISGPGGPPVASVTQQTSELVLTPNVPDIMVAPPDDSHLRHVIDTMALHVLDGGCAFEQAIMERGRGKALFNFLFDLKSKEHTYYVWRLYSFAQGDTLQRWRTEPFIMITGSGRWVPPALPSSRSPDREKESTFAAGRTRRVEVERTLTETQRDEFEDMLRALTLERSQIREAMGFALDNADAAGEIVEVLAESLTLKETPIPTKVARLMLVSDILHNSSAPVKNASAFRTKFEAAIPDVMESFNDLYCSITGRITAEALKERVLKVLQVWADWFLFSDAYLNGLKATFLRPGNSGVTPFHSLCGDAPEIEKKTSSEDNNGFRLDEDVPWPQERQQHERAVKASTC

SEQ ID NO: 6329 - protein, 45 aa, Triticum aestivum
  misc_feature (37)..(37): Xaa can be any naturally occurring amino acid
PRVRVWRLYSFAQGDTLQRWRTEPFIMITGSGRWVPXCFAIQPKS

SEQ ID NO: 6330 - protein, 184 aa, Triticum aestivum
  misc_feature (156)..(156): Xaa can be any naturally occurring amino acid
LSYSSGSDIAGDSGKVDTTEISTDQAIHHQDTIVDEEHRQKLRQIEIAVMQYRESLEEKGLHSMEEIERKVASHRRRLQSDYGLSSIDGANNRRSSERLSLERKERADDARDSSRKRPRSRSRSRSPSRKSSLDRDREHNRSRGRLHGNDAGRDRXREKGSGRGKDDHHDRSSRDREKDRRTGR

SEQ ID NO: 6331 - protein, 186 aa, Triticum aestivum
LGLSYSSGSDIAGDSGKVDTTEISTDQAIHHPDTIVDEEHRQKLRQIEIAVMQYRESLEEKGLHSMEEIERKVASHRRRLQSDYGLSSIDGANNRWSSERLSLERRERADDARDSSRKRPRSRSRSRSPSRKSSLDRDREYNRSRGRLHGNDAGRDRAREKSSGRGKDDHHDRSSRDREKDRRTGR

SEQ ID NO: 6332 - protein, 184 aa, Triticum aestivum
LSYSSGSDIAGDSGKVDTTEISTDQAIHHPDTIVDEEHRQKLRQIEIAVMQYRESLEEKGLHSMEEIERKVASHRRRLQSDYGLSSIDGANNRWSSERLSLERRERADDARDSSRKRPRSRSRSRSPSRKSSLDRDREYNRSRGRLHGNDAGRDRAREKSSGRGKDDHHDRSSRDREKDRRTGR

SEQ ID NO: 6333 - protein, 174 aa, Hordeum vulgare
GDSGKVDTTEISTDQAIHHPDTIVNEEHRQKLRQIEIAVMQYRDSLEEKGLHNMEEIERKVASHRRRLQSDHGLSSIDGANNRRSSERLSLERKERADDARDSSRKRPRSRSRSRSPSRKSSLDRDREYSRSRGRLHGNDAGRDRAREKSSGRGKDDHHDRSSRDREKDRRTGR

SEQ ID NO: 6334 - protein, 105 aa, Triticum aestivum
HEAKAHDTQKEQVLTLTNSEHVDPEPREGREDGPDKGQETLVLADSLMLENGGTCNVPADEDTKNFELFPPKAVALHRLRWNMNKGSEKWLCYGGAAGIIRCQRI

SEQ ID NO: 6335 - protein, 56 aa, Pseudoroegneria spicata
ENGGTCNVPVDEDTKDFDVFPPKAVALHRLRWNMNKGSEKWLCYGGAAGIIRCQRI

SEQ ID NO: 6336 - protein, 1130 aa, Oryza sativa
MAAPPEATGAPPQTEGEEVKDGVEVCVFDESPEVFSRAVHAISELTTGEHEPNFPDAEVERLASSITFLREWRHFSYEPKNVSFTCDARSAPSRVDTHKINLPQFSSASVPQITHLDNGKAKTDRSSMKHEMRDLNLILKALQTCLKISVQSPKLLRYLAVAAHPPGSSYHKIGMPLIGRGIIQVWCLLAPSEEGHPHQSLVACNKYNPSNQPKQRGRPRKTITTSDDHLEPSVKRPRGRPRKYPLPIAKVEDSSQNDRSQEFALIYPLVSPAVVSCDIAIAYPMPTVNPVESTPRKGRGRPRKKPVEIKGLSGIKLTEDLSTALSPIALTCMEPKKKRGRPRKYPAPSNSKHLPGTDTELGNDSVCQPGSIDFGLGPTENTGSGANITHAAVDAASPVPLSGQRGREQPEKEVIHIENSMQSGQSDIGSMLPTYILPESGNKSNSTGLRRRGRPRKKPFPSTTSCVFVPGTETPKKGSTLTNSNNLVVLAKSNCDILANDIGPSSCAIENSVHLSVGTSHAATPAQGICLAKCKEESSAKKGRGRPRKQPISTECGCSKACRGEEQKTQTIPKSSDNASLVENCKKESCPGKGRVQDKKKSVSNERSSVVLSVEAQNMDGSSASTAYTSCCTPACNFENAETNQAVSVPSENSAQVIDELKDTEVARFKESTKDDNMICSAEKTLSRVPKDISLPRVVLCLAHNGKVAWDVKWKPPSANQSEHKSCLGFLAVLLGNGSLEVWEVPSPSMIQKIYSSSSKEGTDPRFLKLKPVFSSAKVKCGNRQSIPLTVDWSPSHDMILAGCHDGTVALWKFSANLSFQGSKPFMCVTAESAPIRTVSWAPSVSKENVNTFVTAGEDGLKFWDLRDPYRHLWELTTAPRAVISLQWLKDARGVVISLEDGTLKFVSLSRIANDVPFTGRPFVGTKTQGVSTYQLSEYLIWSVHASEITGYAAYCVADGTAVCFELTPRFWEKEPGRNRVPYFLCGSLSEEGTTIKIGIALPNSPLSNVPLGTKRATKTCKDVAQLHVIEEGKLLTNSEYNGAINPSIRDGQQDEPDEGQETGAIVLAAPSMQENFDTSTSRGSESPENFEVFPPKAVALHRLRWNMNKGSEKWLCYGGAAGIIRCQRI

SEQ ID NO: 6337 - protein, 956 aa, Oryza sativa
MPLIGRGIIQVWCLLAPSEEGHPHQSLVACNKYNPSNQPKRRGRPRKTITNSDHLEPSVKRPRGRPRKYPLPIAKLEDSSQNDTSQEFALIDPLVSSAVVSCDVAIACPMPTVNPVESTPRKGRGRPRKKPVEIKGLSGIKLTEDLSTALSPIALTCMEPKKKRGRPRKYPAPSNSKHLPGTDTELGNDSVCLLPGSIDCGLGPTENTGSGANITHAAVDAASPVPLSGQRGREQPEKEVIHIDNSMQSGQSDVGSMLPTYILPESSNKSNSTGPRRRGRPRKKPFPSTTSCVFAPGTETPKKGSTLTNSNNLMVLAKSNCDILANDIGRSSCAIENSVHLSVGTSRVATPAQGICLAKCKEESSAKKGRGRPRKQPISTERGCSKACRGEEQKTQTIPKSSDNAALVENCKKESCPGKGSVQDKKKSVSNERSSVVLSVEVQNMDGSSASTAYTSCCTPACNFENAERNQAVSVPSENSAQVIDELKDTEVARFKESTKDYHMICSAEKTLSRVPKDISLPRVVLCLAHNGKVAWDIKWKPPSANQSEHKSCLGFLAVLLGNGSLEVWEVPSPSMIQKIYSSSSKEGTDPRFLKLKPVFSSAKVKCGNRQSIPLTVDWSPSHDMILAGCHDGTVALWKFSANLSFQGSKPFMCVTAESAPIRTVSWTPSVSKENMNAFVTAGEDGLKFWDLRDPYRHLWELTTARRAVISLQWLKDARGIVISLEDGTLKFVSLSRIANDVPVTGRPFVGMKTQGVSTYQLSEYLIWSVHASEIAGYAAYCVADGTAVCFELTPRFWEKEPGRNRVPYFLCGSLSEEGTTIKIGIALPNSPLSNVPLGTKRATKTCKDVAQLHVIEEGELLANSEYNCAINPSIRDGQQDEPDEGQETGAIVLAAPSMQENFGTSTSRGSESPENFEVFPPKAVALHRLRWNMNKGSEKWLCYGGAAGIIRCQRI

SEQ ID NO: 6338 - protein, 107 aa, Triticum aestivum
KVPKAPDTQKEQVLTLTNSEHVDAEPREGRQDGPDKGQETNALALADPLMLENGGTCNVPVDEDTKDFELFPPKAVALHRLRWNMNKGSEKWLCYGGAAGIIRCQRI

SEQ ID NO: 6339 - protein, 107 aa, Triticum aestivum
  misc_feature (3)..(3): Xaa can be any naturally occurring amino acid
KVXKAHDTQKEQVLTLTNSEHVDAEPREGRQDGPDKGQETNALALADPLMLENGGTCNVPVDEDTKDFELFPPKAVALHRLRWNMNKGSEKWLCYGGAAGIIRCQRI

SEQ ID NO: 6340 - protein, 1132 aa, Brachypodium distachyon
MAAPPETTEAPSPPEGEEGNKGIEVCLFDESPEDFSRAVRAISELAGGELEPSFADAEVERLASSITFLREWRHFSYEPKGVSFTSGTGSTSSRDDAHEITLPQFSSASVPQVTHLEDGRCNNTDSCSLFVDRDFKNLFIILLFNVYLAVAAHPPGSSYHKLGMPLTGRGIIQVWCLVAPFEEADPRKAMVAYNKSNRRGRPRKILDENNPIQSSSIPRKPLGRPRKIKSTTTDEHAEPSPKRPRGRPRKHPLPVAKVVDSTKNSGTQDSSFMDPLATSTVVPGDLALSCVVRTVKSAELTPREGRGQTRKTPTNKKKCPPGIESKEDMSTALICMEPKKKRGRPRKYPAQSSSKHVSGTDTELAREAMCLPVTVGCNLGHTGDAQSNSNLSVVTGDTALSVLSSSSKICEKKAKGRGRPKKEAISGSLSCSVVSEDSLLPMHIAPKSNGEESSGRLGRGRRRRKPLSSTNGSLLASGTESPKADTIMNNSDKPMALAKCDGEVGLCNANCKEKSIAKCRGRDRSKLVSTKCNCSNTGEEQKNQRTPKPNDNVFSVENCKKELLVYTRRSVRRTTKRPSPNKSYSLALSCEVQKVKRSSTSIMPKSHLSSVEDPKLLDSSIIGDMVNEACLVGSKSGVVSCEVVGMNDSSTANQVVHVIAEVKDTEVAPFKDSSKNDNMMTCTENSNFSTIPKGIHLPRVVLCLAHNGKVAWDIKWKPPLPNQSEQKSRLGFLAILLGNGSLEVWEVPSPSMIQKIYFSSSVEGTDPRFLKLQPVFRCAKVKCGNRQSIPLTVDWSPSPHDMILAGCHDGTVALWNFSADLPSQDSKPFMCVTAESAPIRALSWAPYASEENTHTFVTAGEDGLKFWDLRDPYRPLWELTTAPRAVLSLHWLKDARGIVISLEDGTLKFLSLPRIASDVPVTGRPFSGTKTQGVSTYQLSEYLIWNVHVSEITGYAAYCGADGTAVRFQLTSRFWEKEPGRNRVPYFLCGSLAEEGTVIKIGGTLQSSPLSNVPLVAKKGPKSFQNVDQAHHIEKEKLQNLTNSGLGDPELREGQPDRPDEGRETNALVLADPLMQENYGICNGSVDESPEDFEVFPPKAVALHRLRWNMNKGSEKWLCCGGAAGIIRCQRI

SEQ ID NO: 6341 - protein, 326 aa, Oryza sativa
RGSKPFMCVTAESAPIRTVSWAPSVSKENVNTFVTGGEDGLKFGDLRDPYRHLWELTTARRAVISLQWLKDARGIVISLEDGALKFVSLLRIANDVPVTGRPFVGTKTQGVSTYQLPEYLIWSVHASEITGYAAYCVADGTAVCFEEKEPGRNRVPYFLCGSLSEGTTIKIGIALPNSPLSNVPLETKRATKTCKDVAQLHVIEEGKLLTNSGNRCHLQLVSFCLYLTCLLNHHTECNCAINPSIRDGQQDEPDEGQETGAIVLAAPSMQENFGTSTSRGSESPENFEVFPPKAVAMHRLRWTMNKGSEKWLCYGGAAGIIRCQRI

SEQ ID NO: 6342 - protein, 1313 aa, Sorghum bicolor
MAAAPPGAGEDIKDGVEVCVFDESADGFLRTVRAISELVDKEPEPDFPEAEVERLSSSITFLREWRHFSYEPKSVTFTSGTESTSSRDDMHSVTLPQFSSASVPQYLAVSAHPPGSSYHKLGMPLTGRGIIQVWCLLAPFEDAHARRSINVCNNSKRRGRPRKIPCSDKLEPIPKGPRGRPRKRPCSDQLEPVPKRPRGRPRKCPLPDAKLEGSSQNGQSQDIILFDSSSVISDDLPLAYVMPTVKSVQSTPKRGADVELGKGTTCQPASFGCSLDHNACTEFNANLSIVAVDAALPLIDKPTCSSGTVSGDVCTAPSPKTVICTKPKKPRGRPRKYPVPINARSVSGTVSGDLWTAPSPTTAICTKPKKPRGRPRKYPVPINGRSVSGTDAELGQETTCQPVSFGCSLEHTVCTELNANLSIVPVDAALPIVDELCSSSGAVVKESVCTEPAPATATRKQPKRTRVMPQKYSDTMIELGKDTTSQPVLSSMGHTACTESNSSFSIVAVDASSSFTSPSTATCDKKSKDDSVLPIHISPKSSNKRESSGKRGRGRPKTIPLSAGTGRFVASGASLPKTTSVLTGSNNLTSLNKSGGKFIVSSLGSCGCDIEKCSVHSGVLLSDDASPAHGLHNANCKEELNTKIGKGGCRKKPVSAEHSHFTDFNVKEQKMQTTPKSGDSVVLVENCMEGQGPRKAGGQLQRIPASNESSGKSVGVETHKIETLSTPMTKGSSKNDDMGHGAGLNQSKNAIAGCEGMKVTESNTANYTSHCNENARANQVAPSFKNSDRVIDETEAAELVPLKESWEDDNMFSCVNSNSSSITRDIAQPRVVLCLAHNGKVAWDIKWKPPLLSQPEQKSRLGFLAVLLGNGILEVWEVPSPCMIQKIYSSSKVEGSDPRFLKLQPVFRCVKVKCRNRQSIPLTVDWSPTPPHDMILAGCHDGTVALWNFSMNLPTQDSKPFMCVTADSVPIRALSWAPYISEESTNTFVTAGEDGLKFWDLRDPYRPLWELTTAPKAVLSLHWLKDGRGIVICLEDGTLKFLSLPRIANDVPATGRPFAGTKTQGVGTYQLSEYLIWSVHASEPTGCVAYCGADGTAVYFQLNSRFWDKEPGRNRVPYFLSGSLSEEGENIKIGSRLQTSPLPNVPVMTKKGSKPCQNIVQGLATNNVTGLLTCQLNSPTRNSDAVNPEVHDDQDNGQSEEQGAGAVNQEHDGDRDDGHSEEHAADMVNTEFGDDQDDGHSEEQGTGAIILASPTKEENDGTWNSKGGESPKDLKVVPPNSVALHQVRWNMNKGSERWLCYGGAAGIIRCQRI

SEQ ID NO: 6343 - protein, 209 aa, Saccharum officinarum
RFWDKEPGRNRVPYFLSGSLSEEGENIKIGSRLQTSPLPNVPVVTKKGSKPCQNIVQALATSDVTGLLTCQLNSPTGNGDAVNPEVHDDQDDGRSEEQGAGAVNQELDGDRDDGHSEEHAAGMVNTEFGDDQDDGHSEEQGAGAIILASPTKEENDGTWNSKGGESPKDLKVVPPNSVALHQVRWNMNKGSERWLCYGGAAGIIRCQRI

SEQ ID NO: 6344 - protein, 284 aa, Aquilegia formosa
NYHVPCRDPHRPLWDVNPVRRFIYSLDWLQDPRCVIMSFDDGTLRILSLSKAAYDVPVTGKPFVGTQQQGLHSYFCSSYPIWSVQASRLKGQVVYCTADGSVLHFQLTSKAVDKDPSRNRAPHFLCGSLTEEDGGLTLNTPLPDIPLPIQKPLKEYGERSIYGLLTDSKQAKRANDQTPDREPLDLLYDGDPSFQIGSGDTETAQESKTTSKKSKKRIPDKGDNQEQSQTEFEVLSPKIVAMHRVRWNMNKGSERWLCYGGAAGIIRCQEISASSTGGRSLVKK

SEQ ID NO: 6345 - protein, 678 aa, Setaria italica
MGVVPSDAASPGHGLYNANFKEESSTKRGSGSRKKLVSTVHSHFTDFSGKEQKTKTTQKSSDPVILVENCMNGPCPRKGGGQPQRIPASNESTSTSVGDETHTMERFLTPMTTGPPRSEDMADEAGLIQANNGIVNCEGMKLNERIAANVTSHCNENAQTNQVAPNFKNSDRLIDEVEATELVPLKEPREDVNMFCSVENSNSSPIPKDIALPRLVLCLAHNGKVAWDIKWKPPVVSQPEQKSRLGFLAVLLGNGSLEVWEVPSPCMIQKIYSPSKVEGSDPRFLKLQPVFRCVKVKCGNRQSIPLTVDWSPSPPHDMILAGCHDGTVALWNFSMNLSSQDSKPFMCVIAESVPIRALSWAPYISDENINTFVTAGADGLKFWDLRDPYRPLWELTTAPRAVLSLQWLKDGRGIVISMEDGTLKFLSLPRIANDVPATGRPFVGTKNQGVATYQLSEYLIWSVHASDTTGCAAYCGADGTAVCFQLTPRFWEKEPGRNRVPYFLCGSLSEDGENIKIGSRPQTSPLPNVPVANKKGPKPCQNIVQALPAGNVIGNPALGDDQNDGHNEEQGAGAENPEPGDNFDDGQNEGGAGVVNPELGDQDGHSEEQEAGAIVLVGPTEQEDDGTLNSKGSESPKDFEVFPPKSVALHRVRWNMNKGSERWLCYGGAAGIVRCQRI

SEQ ID NO: 6346 - protein, 129 aa, Zea mays
AVNLEAHDDQGDGRSKEQGAGAVNQELDGEQDDGHREEQAAGMVTTEFGDDQADGHSEEQGAGAIISATPAKEENDGTWNDKGVQSPKDLNVVPPNSVALNQVRWNMNKGSQRWLCYGGAAGIIRCQRI

SEQ ID NO: 6347 - protein, 1273 aa, Zea mays
MAAAPPVAGEDIKDGVEVCLFDESADGFSRTVRAISELVDIEPETDFPEAEVERLSSSITFLREWRHFSYEPKSVTFTNGTESTSYRDDMHSVTLPQFSSASVPQYLAVSAHPPGSSYHKLGMPLTGRGIIQVWCLLAPFEDSHSHQPVNAFNNGKQRGRPRKIPCSDKLVPVPKGPRGRPKKRSYDDQLEPVPKRPRGRPRKYPLPVAKFEGSSQNGESQDIILFDPLSTSSFIPDDLSLASVMPTEKSVQSTPKRGADVELGKETTCQTASFGCSLDHTACTEFNAKLCIVAVDAALPPIDKLTCSPGTVSGDVCTAPTLTTAICTKPKRPRGRPRKYPVQINGRSVSGTVAELGQESTCQPVSFGHTVCTEFNANLSIVPVDAALPIVDKLCSSSGTVVKESVCTEPSPATATRKQPKRTRGMPRKYSDTMIDLGKDTTGHPVLFGRSMDHTACTESNSSFSIVAVDASSLFASSSTATCDDKSKDDSELPIHISPKSSNKRESSGRRGRGRPKTIPLSAGTGHFVASVASLPKTTCVLTSSSNLTSLNKSGGKFIVSSVSSCGCDVEKCSVHSGVLLSDDAPPAHGLQNTNCKEESNTKIGKAGSRNKPVAVEHNHFTDLNVKEQKVQTTPMSGDPVILVENCMEGQGPRKAGGQLQRIPASNKSSGASVGGGTYKIETLSTPMTKGSSKNNDMAYGAGLNQSQNAIVGCEGMEVIESNTANYTSHCNENARANQVAPSFKNSDRVIDETEAAELGPLKEPREDDNLFTCVNSNSASITSDIAQPRVVLCLAHNGKVAWDIKWKPPLLSQPEQKSRLGFLAVLLGNGALEVWEVPSPCMIQKIYSPSKVEGSDPRFLKLQPVFRCVKVKCRNRQSIPLTVDWSPSPPHDMILAGCHDGTVALWNFSMNLPTQDSKPFMCVTADSVPIRALSWAPYISEESTDTFVTAGEDGLKFWDLRDPYHPLWELTTAPRAVLSLHWLKDGRGIIISLEDGTLKFLSLPRIANDVPATGRPFSGTKTQGVATYQLSEYLIWSVHASEPTGCVAYCGADGTAVYFQLKSRFWDKEPGRNRVPYFLCGSLSEDGENIKIGSRLQTSPLPNVPVGTKKGSKPSQSIVQALATSDVTSLLTYQLNSPTGNNDAVNLEAHDDQDDGRSKEQGAGAVNQELDGEQDDGHREEQAAGMVTTEFGDDQADGHSEEQGAGAIISATPAKEENDGTWNDKGVQSPKDLNVVPPNSVALNQVRWNMNKGSQRWLCYGGAAGIIRCQRI

SEQ ID NO: 6348 - protein, 193 aa, Avena sativa
GVSTYQLSEHLIWNVHVSEITGYAAYCGADGTTVRFQLTSRFWEKEPGKNRVPYFLCGSLAEEGSVIKIGGTLQHSPLPNVPLVAKKGPKAQDIRKEKLQTITNSEFVDPEPREGQLDGPDEGQESNALVLADHLMQENGGICKNTVDEYPKDFEVFPPKSVALHQLRWNLNKGSEKWLCYGGAAGIIRCQKI

SEQ ID NO: 6349 - protein, 356 aa, Panicum virgatum
  misc_feature (91)..(91): Xaa can be any naturally occurring amino acid
  misc_feature (101)..(101): Xaa can be any naturally occurring amino acid
  misc_feature (111)..(111): Xaa can be any naturally occurring amino acid
  misc_feature (137)..(137): Xaa can be any naturally occurring amino acid
  misc_feature (173)..(173): Xaa can be any naturally occurring amino acid
  misc_feature (301)..(301): Xaa can be any naturally occurring amino acid
QDSKPFMCVTAESGPIRALCWAPYISENINTFVTAGADGVKFWDLRDPYRPLWELTTAPRAVLSVQWLKDGRGIVISMEDGTLKFLSLARXANDVPATGRXFVGTKTQGVXTYQLSEYLIWSVHASDTTGCAAYCGXDGTAVCFQLTPRFWEKEPGRNRVPYFLCGSLSEEGXNIKIGSGQQMSPLPNVPVVNKKSTKPCQNIVQGLPASNVTGPPVCQLNTPTGNRDIVNPELGDDQDDGHSEEQGTSAVNPELADDQDDGHSKEQGAGAVNPELGDDQGGHSEEPGAGAIVLAGPTEQXDAYSLNFKGGESPKDFEVFPPKSVALHRVRWNVNKGSERWLCYGGAAGIIRCQRI

SEQ ID NO: 6350 - protein, 76 aa, Panicum virgatum
DGYSEEKGAGAIVLAGPTEQEDAGTLNSKGVEFPKDFEVFPPKSVALHRVRWNVNKGSERWLCYGGAAGIIRCQRI

SEQ ID NO: 6351 - protein, 966 aa, Malus domestica
MNNAVEEEVEVEPPLAVLLAPKRGKTTKTKRKSQPATTSNQQNPEPEPVRIEPEPVRIEPEPVGVEPEGVRIEAEPVRIGEEGSRNGSTVRVSMFDDSVENHFRVMDTIAKLCGEAEEDRGVEDGEIQPLSSSITFLREWADFKYEPRDVRFACGVGSPEGEDVVGGINLRQFSSATVPKNEALSGVAQSPELSQDFLMYVGGPVWALDWCPRVHQSSDGHPKCEFIAVAAHPPGSSYHKLGEPLTGRGAIQIWCLLNAGVNKEDEHSIAEKQKQGRKNSGARQENSTEPKKPLGRPRKKPIEEKSTEPKRPRGRPRKKPIEESADKEATEEKSTRPKRPRGRPKKYAVEDYVDNLDESNDYVEVLAIEYPEGSLELPSMDCVPANTHVHVVQEDHGKKRKNHHTQQNSGHDPQTSKNVQNNGYSETGSTRCSVPTDVALPRIVLCLAHHGKVAWDVKWRPLNERDSKSKYRMGYLAVLSGNGSLEVWDVPLPRAIEVIYSSSCGEGTDPRFVKLAPVFRCSMLKCGGEKSIPLTVEWSPSPPYDYLLVGCHDGTVALWKFSASNASQDTRPLLCFSADTNPIRALAWAPAESNSEGAHLIATGGHGGLKFWDLRDPFRPLWDLDHLPRFIYSLNWLPDPRCVLLSFDDGTMKAISLVKAASDDPVTGRVGTKQPGLHNLSCLPFAIWSVHASQLTGMVAYCGADGTVLRFQTLFSRGGKFLSYRRYLSVSKIFSNIRPALTTKSLEKDPRRNRAPHFLCVSLTMEESAVIINTPVSNSPFPLKVARNNAESNKVKTTNDKMAKDNTSEDQSLALCYGDDPGIELEGGGEVAPLKSKKTQKSKSSTKKPDDDQALVCIDEEPTAAQEEETGVASLDGKKTKKSKSSKKNADDDQALVCMDEEPTNREEETVKEPEVFPDKTVAMHRVRWNMNKGSERWLCYGGAAGIIRCQEIVLSDVDRAWAAKR

SEQ ID NO: 6352 - protein, 890 aa, Theobroma cacao
MLWIKEKEKEKMEEPLKGRPGVRVSIFDCSIENHFRAMDTISKLCEEPESDGPDETDIQRFSSSITFLREWRHFNYEPRIIKFASEVGDSQGKDVSDCIQLPQFSSATVLKVKENLQREGLNGKASPKSCLYYNTIANEVCHIHFLNNMIKVQSTCSKDFVMYVGGSVWALDWCPRVHENPNSTVKCEFIAVAAHPPDSYYHKIGTPLTGRGIIQIWCMLNVGVEEEEAPLSKKRPKWRSQTTEAMEESPSKRPRGRPRKNPIDESQPDKVKRPKGRPRKKPIGESLNDDQNEQSFLPLAVQYPEGSFKPVAIDSALGNTQENAPNKSHHEKEKGEKEGAFTSDATPTTSVQSRKLKSKVQAKTNTHGSSIPRDIELPRTVLCLAHNGKVAWDVKWQPYDINDCECNQRMGYLAVLLGNGSLEVWEVPLPHMISIVYSSSPKQGTDPRFVKLEPVFKCSKLKCGDVQRRKNNSNERLCYVVQCSPCPILWLVDILDAPRGSDLLYSIPLTVEWSTSPPHNYLLAGCHDGMVALWKFSASGSPTDTRPLLCFSADTVPIRSVAWAPSGSDMESANVVLTAGHGGLKFWDIRDPFLPLWDVHPAPKFIYSLDWLPEPRCVILSFDDGTMKMLSLIQAACDVPVTGKPFTGTKQQGLHLYNCSSFAIWNVQVSRLTGMVAYCGADGNVTRFQLTSKAVDKDFSRNRAPHFVCGSLTEEESAIVVNTPLPDIPLTLKKQTNDYGEGPRSMRAFLTESNQAKNAKDNKAKVPTPDKQTLALCYGNDPGVESESEETLTLAALKGKIKQKSKSDRMKKAGDDQALAVRINEPANTQKEEAGNEIEVFPPKIVAMHRVRWNMNKGSERWLCYGGAAGIVRCQEIIVPDVAKKSARKS

SEQ ID NO: 6353 - protein, 424 aa, Citrus clementina
MKAIYLSSMKEGTDPRFVKLEPVFRCSMLKCGGTQSIPLTMEWSTSPPHDYLLAGCHDGTVALWKFVASDSSIDSRPLLCFSADTLPIRAVSWAPAESDSDSANVILTAGHGGLKFWDIRDPFRPLWDIHPAPKFIYGLDWLPDPGCVILSFDDGAMRIVSLLKAAYDVPATGKPFAGTKQQGLHLVNCSSFAIWSVQVSRLTGMVAYCSADGTVHRFQLTAKAVEKDHSRNRPMHFLCGSVTEDESAITVNTPLDNTPVPLKKTVHDAGERSMRSFLIESNSSKSPNDKKGKNVLSSDNQPLALCYGNEPGEESEGDMTLAALKNKQKPKSRSSSKKKEEDDQAMVCIDEEAMDIQGKENEKGEAGNGIEVLPPKVVAMHRVRWNMNKGSERWLCYGGAGGIIRCQEIRVPDIDKKMGKKIQK

SEQ ID NO: 6354 - protein, 253 aa, Gossypium hirsutum
GMVAYCGADGTATYFQLTSKAVDKDFSRNRSPHFACGSLTEEEPAVIVNTPLPDNPLPLKKPSSECGDGQRSMRYFLTESLGKNAKDRKAKVPTSNQRTLALYDGNDPSVESEPEETLAALKSKMKPKSKSERTLALCSGNDPSLESEPEETLAALKSKMNPNSKSDGKKKANDSQALAQGTKEATNKEREETEKEGESQMETFPPKIVAMHRVRWNMNKGSERWLCYGGAAGIVRCQEITVRDVDTKLTRKR

SEQ ID NO: 6355 - protein, 211 aa, Eucalyptus grandis
MVAYSGADGNVCQFQLTSKAVDKDPSRHRAPHFLCVSVAEEGSAIVLNMSPSDTPVTLGKQLKGTPSSTHEMLSASPEVEEAMENEDKGPTPDDQILALCYGDDPSVETGWEETLASFKSKKNQTSGKLNKKRPRVEMQRDKEPETVPEGAENAVTLTEFETFPPKIVAMHRVRWNMNKGSEKWLCSGGAAGILRCQQINTLSTDRKSKWK

SEQ ID NO: 6356 - protein, 713 aa, Eucalyptus grandis
SVLFRSKDFVIYVGGSIWALDWCPRVCHRPEYQTKNEFIAVAAHPRGSSQHKLGAPLTGRGVIQIWSLLNISGDGEEASLVDKPRQRRANSQSLKEKSSQPPRPRGRPRKKPLERPSDDSNCNSQFGQPLAGDFPEKTPVSYTLDGVSGVLSAQIAGKDSGQKRRSSEAAASPNTGRRLDNVGGVESCHVNEHVSIMTENEERFLPCINQQGQSGFRACSAGNNAVGSYSRSSSGTLISEDVAAPRLVFCFSHNGKVAWDVKWRPFDMHETKCTHLMGYLAVVLGNGSIEVWEVPLPQTVKVIYSSTQREDTDPRFIKLEPVFRCSTLKSGGIQSIPLSVEWSTSHPHEYLLVGCHDGTVALWKFFASNSSKDTRPLLHFTADTVPVRAVAWAPFGSDPESVNVIVTAGHGGIKFWDMRDPFHPLWHIHSAPKNILSIDWLPDPRCVLLSFDDGTVRLLSLSRSAYDGPVTGKPLSSTKQRLHTLYCSSFAIWSVHVSRHTGMVAYSGADGNVCQFQLTSKAVDKDPSRHRAPHFLCVSVAEEGSAIVLNMSPSDTPVTLGKQLKGTPSSTHEMLSASLEVEEAMENEEEGPTPDDQILALCYGDDPSVETGWEETLASFKSKKNQSSGKLNKKRPRVEIQRAKEPETVPEGAENAVTSTEFETFPPKIVAMHRVRWNMNKGSEKWLCSGGAAGILRCQQINTLSTDRKSKWK

SEQ ID NO: 6357 - protein, 518 aa, Citrus sinensis
MNLVATWMVLNKQNIETTFCDFLSKPSLVSCPIPKDIALPRVVLCLAHNGKVAWDVKWKPYNAVDCKCKQRLGYLAVLLGNGSLEVWEVPLLRTMKAIYLSSMKEGTDPRFVKLEPVFRCSMLKCGGTQSIPLTMEWSTSPPHDYLLAGCHDGTVALWKFVASDSSIDSRPLLCFSADTLPIRAVSWAPAESDSDSANVILTAGHGGLKFWDIRDPFRPLWDIHPAPKFIYGLDWLPDPGCVILSFDDGAMRIVSLLKAAYDVPATGKPFAGTKQQGLHLVNCSSFAIWSVQVSRLTGMVAYCSADGTVHRFQLTAKAVEKDHSRNRPMHFLCGSVTEDESAITVNTPLDNTPVPLKKTVHDAGERSMRSFLIESNSSKSPNDKKGKNVLSSDNQPLALCYGNEPGEESEGDMTLAALKNKQKPKSRSSSKKKEEDDQAMVCIDEEATDIQGKENEKGEAGNGIEVLPPKVVAMHRVRWNMNKGSERWLCYGGAGGIIRCQEIRVPDIDKKMGKKIQK

SEQ ID NO: 6358 - protein, 117 aa, Silene vulgaris
MKKSATEWSNTPRSARTVASGLHYGKRVKKGAEKNPNQGEEVLALCDGDDAEPGVANDAGKKDKAQSEVEEPPPKLQAMYRVRWNMNKGSERWLCYGGAAGIVRCQEIVIPQFDKKL

SEQ ID NO: 6359 - protein, 662 aa, Fragaria vesca
MAPEGAEPVQIEPVPVPVEPENSRNGPPRVSVSMFDDSVENHFRVMHKISELCGEAEDELLPETELQRLQSSTTFLWEWADFKYEPRDVQFACEAGSPNEEDVISGINLRQFSSASVPQNEAWDTSSPELSQDFVMYVGGPVWALDWCPRVHESHDCPAKCEFIAVAAHPPGSSYHKLGEPLTGRGAIQIWCLLNASVNDEGVPIGEKPKGGTKRSAAITEQIRPLGRPIKKPIEESVGKKATEEKLTEPKRPRGRPRKKPIEEAIDKEAKEKKSTEPKKPRRPRKKSIEEYVDNLDGTTNCVEVLAIDFPNESSKLHSTDCVPATTQGNDIQDHDKKLSTHDGKQESSGWKPNNNVTNNGYAENGSTSCSVPKDVAVPRIIFCLAHHGKVAWDVKWRPLNDDSRCKHRLGYLAVLLGNGSLEVWEVPVPRAIEVIYSSSSGEGTDPRFVKLAPVFRCSMLKSGDKKSIPLTVEWSASPPHDYLMAGCHDGTVAMWKFSASNASQDTRPLLCFSADTNPIRALSWAPVESNSDGANVIATAGHGGLKFWDLRDPFRPLWDIDHIPRFIYSLDWLSDPRCVLLSFDDGTMRLLSLTKVASDAPATGKPFAGTKQQGLHNLGCLPFAIWSVQVSRLTGMVAYCGADGTVLRFQLTSKAVEKDAS

SEQ ID NO: 6360 - protein, 422 aa, Tripterygium wilfordii
MGYLAALLGNGSLEVWDVPLPHAMKSIYSSSCKEGTDPRFVKLEPVFRCSMVKSGGIQSIPLTVEWSTSSLQDYLLAGCHDGTVALWKFSAGGSSGDTKPLLCFSADTFPIRAVAWAPVGSDPEGANVILTAGHGSMKFWDIRDPFRPLWDIHPAPRFIYSLDWLPDPSCVILSLDDGTMRLLSFVKSAYDVPVHGKLTVGPKQLGLHTFNCSSFAIWNVQVSRLTGMVAYCSADGTATRFQLTRKAVEKDFSRNRAPHFVCGSLCVDESALVVCSSLADTALTLKKPTNDSAETPRSMRDFLLPPNHLKRCNDKKAKGPILDDDTLALCYGDDPGTECGTDETLASCKSKTRPKSESSKKNAKDDEALLCRDEDSSKKKAKDDQGFVCEDEEPDMHDKENGKGGKVIKLKISLPKRLQCIE

SEQ ID NO: 6361 - protein, 131 aa, Malus domestica
PGIELEGGGEVAPLKSKKTQKSKSSTKKPDDDQALVCIDEEPTAAQEEETGVASLDGKKTKKSKSSKKNADDDQALVCMDEEPTNREEETVKEPEVFPDKTVAMHRVRWNMNKGSERWLCYGGAAGIIRCQ

SEQ ID NO: 6362 - protein, 381 aa, Arabidopsis lyrata
MGEQSPSQPSTQSQSRPQSPKPDTHNLIPPESTDACIDSAGVSGSIVSSTTIDAGRITELGNVSSPPSKIPLRPRKIRKLTLDGDVSGEDYKAEDISSQVTSPLATGKSPGKGKLSQSRVITVPRIQARPLTCEGELETAIHYLRNADPLLAALIDVHPPPTFESFKTPFLALIRSILYQQLATKAGNSIYTRFVALCGGENVVVPETVLALNPQQLRQIGVSGRKASYLHDLARKYQNGILSDSAILNMDEKSLFTMLTMVNGIGSWSVHMFMINSLHRPDVLPVNDLGVRKGVQMLYGLDDLPRPSQMEQHCAKWRPYRSVGSWYMWRLIEGKGTPTSAVTPGAAMSLPPLEDIQQEHQQQQLMDPLNSVFSIGYGINC

SEQ ID NO: 6363 - protein, 815 aa, Arabidopsis thaliana
MDGEECNISLFDYSAESHLKAVESITDLCGEANADIDENDINILSSSVTFLREWRHYNFEPKSFAFYNEAEKNHQPKDINSQTLPQFSSARAPKVKIHDDESSSSGEISKDFVMHVGGSVWAMEWCPRVHGNPDAQAKCEFLAVATHPPDSYSHKIGIPLIGRGIIQIWCIINATCKKDSGQVSDKGKKLTGKSRKQPSGETTETTEPKKPRGRPRKHPVETTEPKKPRGRPRKKSTAELPVELDDDVLYVEALSVRYPENSVVPATPLRILRETPVTETKVNNEGSGQVLSSDNANIKLPVRRKRQKTKSTEESCTPMILEYSEAVGNVPSKPSSGISEDIVALPRVVLCLAHNGKVVWDMKWRPSYAGDSLNKHSMGYLAVLLGNGSLEVWDVPMPKATSALYLSSKKAATDPRFVKLAPVFKCSNLKCGDTKSIPLTVEWSTLGNPDFLLAGCHDGTVALWKFSTTKSSEDTRPLLFFSADTAPIRAVAWAPGESDQESANIVATAGHAGLKFWDLRDPFRPLWDLHPVPRFIYSLDWLQDPSCVLLSFDDGTLRILSLVKVAYDVPATGRPYPNTKQQGLSVYNCSTFPIWSIQVSRLTGIAAYCTADGSIFHFELTTKAVEKDTRNRTPHYLCGQLTMKDSTFIVHSPVPDIPIVLKKPVGETGEKQRCLRSLLNESPSRYASNVSDVQPLAFAHVEDPGLESESEGTNNKAAKSKAKKGKNNARAEEDENSRALVCVKEDGGEEEGRRKAASNNSNGMKAEGFPPKMVAMHRVRWNMNKGSERWLCYGGAAGIVRCQEIAPTSDWKPRR

SEQ ID NO: 6364 - protein, 551 aa, Artemisia annua
LAEDFSDIVPEALDKVVPEKASSRKRKGYEKQTSVKSALTSKSRLAKCKLSSESQDPMGSCATGYSVPLETDPDSCDISEDISLPRLVMCLAHNGKVAWDIKWRPVDTSANLKHRMGYLGVLLGSGALEVWEVPLPHAAEAMFSACQKDGTDPRFIKLKPVFRCAMLKCGDRQSIPLTMEWSTASPHDLILAGCHDGMVALWKFSANSPLKDTKPLIFFSADILPIRALAWAPVACDFESANIIVTAGHKGVKFWDIRDPFRPLWDVNPVQRVIYGVDWLSDPRCVVLSFDDGEIRIISLSKAACDVPVTGKPFVGTQLQGLNSYHCSSSSIWSVQVSKLTGMVAYCCSDGRVLRFQLTAKSVEKDPRRNREPHYLCGALTTEGSTLNVFSPLPDELGETPRSRRGHLTISNQEKRAREQGLKCQMPEDQAIPQAREQGLRCYTPEEQPLALCYNNDPGVDSGSDDTMVAQKSKTSKTKGTSKKKPKADAKQAFTSTDEVPDVETINEKEVFPSKIVAMHRVRWNMNKGSERWLCYGGAAGIVRCQEISLG

SEQ ID NO: 6365 - protein, 94 aa, Brassica juncea
NTIEEEEEDNRGALVCVKEDGDAEEGRRKEASTSSSSVKAERFPPKMVAMHRVRWNMNKGSERWLCYGGAAGIVRCQEIASSGLVGKQNWRHQR

SEQ ID NO: 6366 - protein, 609 aa, Gossypium hirsutum
MFHIRIIKNKKLRKEATCTSDATPQTSKKSIKLKSKTQEKITVIVKLKNEKSESSAMNQQIHFNTGQEATVSNNVLGCNSIKVSPGSLSIPGDIALPRAVLCLAHNGKVAWDVKWQPYHKHDSKCNQRMGYLAVLLGNGSLEVWEVPLLNMIKTIYSTSPKQGTDPRFVKLDPVFKCSKLKCGDIQSIPLTVEWSTSPPHDYLLAGCHDGMVALWKFSASGSPKINDTRPLLCFSADTAPIRSVAWAPSGSDMESSNVILTAGHGGVKFWDIRDPFLPLWDVHPAPKFIYSLDWLPEPRCVIISFDDGTMRLLSLVQAACDVPVTGKPFGGSKQQGLHVYNCSSFAIWCVQVSRLTGMVAYCGADGTATCFQLTSKAVDKDFSRNRSPHFACGSLTEEEPAVIVNTPLPDKPLPLKKPSSECGDGQRSMRYFLTESLGKNAKHRKAKVPTSNQRTLALYDGNDPSVESEPDETLAALKSKMKPKSKSERTLALCYGNDPSLESEPEETLAALKSKMKPNSKSDGKKKDNDRQALAQGTKEATNKEREETEKEGESQMETFPPKIVAMHRVRWNMNKGSERWLCYGGAAGIVRCQEITVRDVDTKLTRKR

SEQ ID NO: 6367 - protein, 64 aa, Lactuca sativa
  misc_feature (7)..(7): Xaa can be any naturally occurring amino acid
RMREKHXPPKIVAVHRVRWNMNKGSEKWLCYGGAAGILRFQEINLLGNKKEKRKTLHDLSVSTI

SEQ ID NO: 6368 - protein, 353 aa, Pennisetum glaucum
VALWNFAMDLSSQDSKPVMCVTAEFVPIRALSWAPYISDENINTFVTAGADGLKFWDLRDPYRPLWELTTAPRAVLSLQWLKDGSGIIISMEDGTLKFLSLPRIANDVPATGRPFVGTKNQGVATYQLSEYLIWSVHASDTTGCAAYCGADGTAVCFQLTPRFWEKEPGRNRVPYFLCGSLSEEGENIKIGSRPQTSPLPNVPVANKKGPKPRQEIVQALAAGDVIVNLAFGNDQNDGHNEEQGAGAVNPELGDDQDGGQNEGQGAGAVNTELDEDQDGHSEEQGAGAIVLVVPTEQEDDGTLDSKGGESPKDFEVFPPKSVALHRVRWNVNKGSERWLCYGGAAGIVRCQRI

SEQ ID NO: 6369 - protein, 146 aa, Triticum aestivum
SARGCGSLAEEGTVIKIGGTLQSSPLSNVPLVTKKGPESCQDVDQTDDMRKEELRTLTNSEHVDPELRDGELDEGRETSALVLADALMQESDGMHNGPVDENAKDDLEAFPPKSVALHRLRWNTNRGSERWLCYGGAAGIIRCQRI

SEQ ID NO: 6370 - protein, 212 aa, Aristolochia fimbriata
KPWWSPKHSSYSRVVIFSTLHPIISWFSMMVALWKFIASATVASQDTRPLLCFTADNVPIRAVAWGPAERNEESANLIVTGGHEGLRFWDLRDPYRPVWDLNPIRRVVLSIDWLQDPGCLLLAFDDGTLRILSMCQAANDTPVSGKFCRGSNQQGLHFYCYSTFPIWNLHISRLTGVVAYCVADGSALCFQVFFSILYSHVGPTRLDGQFCS

SEQ ID NO: 6371 - protein, 138 aa, Euonymus alatus
PVPDNNTLALCYGDDPGTESGPDETLASLKSKTRPKSRSSKKKAKDDGALLCWDEESSKEKPEDDQGFAYEDEEPDMHGKENRNDGKCNQTEDFPSKTVAMHRVRWNMNKGSERWLSYGGAAGIVRCQEIMTSHAAWR

SEQ ID NO: 6372 - protein, 61 aa, Olea europaea
MGNFPGEGSDKGQMRHEIEVFPPKIVAMHKVRWNMNKGSERWLCYGGAAGLIRCQEVDMST

SEQ ID NO: 6373 - protein, 898 aa, Fragaria vesca
MSEEGVEPPLAVLLRCKRGKTKSAKKPSQSTQIAPEPVPIDAQPVRIEPEPVSVAPENSRNGPPRVSVSMFDDSVENHFRVMHTISELCGEAKEDEPVPETELQRLQSSTTFLREWADFKYEPRAVRFACQAPSPDEEDVISGINLRQFSSATVPQNEAGDTSSPELSQDFVMYVGGSVWALDWCPRVHECLESHAKCEFIAIAAHPPGSSYHKLGEPLTGRGAIQIWCLLNASVKDKGGPIGEKPKGGKKRSAVIEKCTEQKRPRGRPRKKPIEEAIDKEAKAEKSTEPKRPRGRPRKKSIDESVGNLDGRTNAKISRGKAGEKPIEHSVDNLDGSSHYTEVLAVQCIKETSELHCVPALTQAHDIQEAHDGKQESSGWKTNDIVSNNDYAENGSTSYSVPKDVALPRIIFCLAHHGKVAWDVKWRPLNEYDSRCKHRMGYLAVLLGNGSLEVWEVPVPRAIEVIYSSSSGEGTDPRFVKLAPVFRCSMLKSGDKKSIPLTVEWSASPPHDYLIAGCHDGTVAMWKFSASNASQDTRPLLCFSADTNPIRALSWAPVESNSDGANVIATAGHGGLKFWDLRDPFRPLWDIDHIPRFIYSLDWLPDPRCLLLSFDDGTMRLLSLTKVASDAPTTGKPFTGTKQQGLHNLGCLPFAIWSVQVSRLTGMVAYCGADGTVLRFQLTSKAVEKDAIRNRAPHFLCVSLTEEDSVVTINTPVLNNPFPLKTSRKAEPNKVKREHDKMATASEDKVLALCYGDDPVVELESGKEAPSLRSKPRTSGDDQALACMDHEPFNTLEEEIGEKGASLKSIVKQKSKSSKKTEDEQELVCRDEELNNMQREKIGTEYEVFPSKLIAMHRVRWNMNKGSERWLCYGGAAGLVRCQEIALSEIDTKWARKK

SEQ ID NO: 6374 - protein, 835 aa, Solanum lycopersicum
METGDDFSVAAELKRCKQKRKSQPKSNNIVPESPATAPAKVAGGEFSSGIPVSLFDYSVENHFKAVDIISKLTGVPDIDDTDRTELNRLASSITFLTEWRFLKYKTREVKFACENESSKGKDVIGEISLPQFSSAEVPKKQLVNEQPVPEKSSKDFVMYVGGLAWGMDWCPQAHENRDAPMKSEFVAIAPHPPDSSYHKTDASLTGRGVIQIWCLPDLIQKDIIVKEDYFAQVNKKPYRNLTRSEAGTGEVSGPQKPRGRPKKNPGKAVQAKASRPQNPRGRPRKKPVTESLGDRDSEDHSLQPLAIEWSLQSTELSVDLSCGNMNKAQVDIGLSQERCINAASLDSPLTGVRNKATLKGQTEKSGVIPLTQDVAEESPAVSSQAYTSNRLDIPTDVSLPRMVLCLAHNGKIARDIKWRPSNHYDVSRHRMGYLAVILGNGTLEVWEVPFPHTIKAIYPSVQKKGTDPRFLKLQPVFRCSMLKGCDGQSIPLTVEWSASPLHDMILCGCHDGVVALWKFSANNSSKDTRPLLCFKADTGRIRALSWAPLESDSGNTNIIIVAGDKGLKFWDLRDPFRPLREYHVGSGVHICSVDWLPEPRFIVISCDDGTLKILGLPKAAYDAPVTGNLLVGTKQQGFHSFTRSRLGIWSVQASRITGMVAYCGVDGTAARFQMSSKMYNDPLRTRAPHFLCGSFSEDESGISVVTPVPNTPFRMIYSGKQWRDAIPRSPHGLDKRMIEQSDEQPLALCYGDDPNVEGGSDDELASQSSKTKTKSTSKKPEAAEEEATRLRQKFEKLPPKILSIHRIRWNMNKGSERWLCYGGAAGLVRCQQIDL

SEQ ID NO: 6375 - protein, 94 aa, Hordeum vulgare
ELLTLANSEHVDSEVGDGELDEGQETGALVLADALMQENDGMHNGPVDEKAKDDFEVFPPKAVALHRLRWNTNRGSERWLCYGGAAGIVRCQRI

SEQ ID NO: 6376 - protein, 94 aa, Hordeum vulgare
ELLTLANSEHVDSELGDGELDEGQETGALVLADALMQENDGMHNGPVDEKAKDDFEVFPPKAVALHRLRWNTNRGSERWLCYGGAAGIVRCQRI

SEQ ID NO: 6377 - protein, 118 aa, Brassica napus
EDPGLESETEGTSNKGSRSKAKKGKNNTIEEEDNRGALVCVKEDGDEEERRRKEASNSSSSVKAETFPPKMVAMHRVRWNMNKGSERWLSYGGAAGIVRCQEIASSGLVGKQNWRHQR

SEQ ID NO: 6378 - protein, 308 aa, Brassica napus
MFFFFFCSDPCRPLWDLHPVPRFIYSLDWLQDPKCVLLSFEDGTMRILSLVKIAYDVPATGRPYPNTKQQGLSVYNCSSYPIWSIQVSRLTGMAAYCTADGSVVHFQLTTKAVEKDPRNRTPHFLCGRLTMNDSTFIVHSPAPNVPIMLKKLISENGEKQRCLKSLLNESPNRHTSPVSDGQPLAFAQDEEPGLESEPEETNKKGSKSKAKKGKGNTIEEDENRGALVCVKEDGDEGEEGRRKEGSNSSSRVKVERLPPKMVAMHRVRWNMNKGSERLLCYGGAAGIVRCQEIASFGSVGKPNLRPHR

SEQ ID NO: 6379 - protein, 813 aa, Populus trichocarpa
MEEQEELLGGNGVGIRVSTFDYSVENHFKEMDMISKLCGEAQTDSVDEIEIQCYKSSITFLRSWKLYKYDPRIIRFASETDNSLEKCVLSGINLPLFSSATVPKVLKDFVMHVGGSVWALDWCPRVHERPDNHIKREFVAISAHPPESYYHRIGVPLTGRGMVQIWCVLNALVKMPKGRPRKRPIEESPCNEATELISAKRPKGRPRKKPIEESPIKRGGRPRKNPTNESLDSLDSSNQYVQALSVEYPQDSPGLLSIEGISQNSQDEAKQKHKGSDSGDVACPLLLIHNEDDNVSLDINSTSSTVNYQTHENSGLNTAMPAYGSDNVSLDINPTSSIPKDADLPRVVLCLAHNGKVAWDVKWQPCNAPPSKFQHRMGYLAVLLGNGSLEVWDVPLPHAMKSVYSSSNLEGTDPRFVKIKPVFRCSTLKCGGIQSIPLAVEWSTSYPHDYLLAGCHDGTVALWKFSASGASGDTRPLLCFSADTVPIRAIAWVPSESDQESPNLILTAGHLGLKFWDIRDPFRPLWDLHPAPKLIYSLDWLPDPRCIILSFDDGTMRLLSLARAAYDAAVNGKPSVGPKQLGMHVVNCSSFAIWSVQVSRLTGMVAYCSADGTVCRFQLTTKAVEKDPSRHRAPHFGCGSLSEDESAIIVGTPLPDTPLPLKKPVNDVGNNPKSKQRLSVSNKAAKIPTSDDPPLALCYGDDPGMDHGSDETLTATKSKRKPKSKSGSKQMEGEDQALVCIDDEQDVKQKGGGKEGAGNVVESIPPKMVAMHRVRWNMNKGSERWLCSGGAAGIVRCQEIKMFDADICLARKR

SEQ ID NO: 6380 - protein, 436 aa, Prunus persica
MGYLAVLSGNGSLEVWDVPLPHAIEVIYSSSCREGTDPRFIKLAPVFRCSMLKCGSEKSIPLTVEWSASPAHDYLLAGCHDGTVALWKFSASNASQDTRPLLCFSADTNPIRALAWAPVDSSSEGANVIATAGHGGLKFWDLRDPFRPLWDLDHLPKFIYSLDWLPDPRCVILSFDDGTMKVISLVKAASDDPVTGMAGTKQPGLHNLSCLPFAIWSVHVSRLTGMAAYCGADGTVLRFQLTSKSVEKDPRRHRAPHFLCVSLTMEESAVTINTTVSNTPFPLKVVRNNPESNKVKSANDKRAKDSASEDQTLALCYGVDPDIQSESGEKVASLRRKKTKKSGSSETTPEDDQALVCIDEEPTSTQEQEIGEKVASEEEDGKELEIFPDKIVAMHRVRWNMNKGSERWLCYGGAAGLVRCQEIVLSDTEKAWAMKR

SEQ ID NO: 6381 - protein, 269 aa, Solanum phureja
LPCISNRDPFRPFREYHVGSGVHICSVDWLPEPRFIVISCDDGTLKILGLPKAAYDAPVTGNFLAGTKQQGFHSFTRSLLGIWSVQASRVTGMVAYCGVDGTAARFQIASKMYNDPMRTRAPHFLCGSFSEDESGISVVTPVPNTPFRMIYSGKQWRDAIPRSPHGQDKRVIEQSDEQPLALCYGNDPNVEGGSDDELASQTSKTKTKSTSQKPEAAEEEGTQSRQKFEKLTPKILSIHRIRWNMNKGSERWLCYGGAAGLVRCQQIDL

SEQ ID NO: 6382 - protein, 407 aa, Solanum lycopersicum
NGSDVLQDIPTDVSLPRMVLCLAHNGKIARDIKWRPSNHYDVSRHRMGYLAVILGNGTLEVIPLTVEWSASPLHDMILCGCHDGVVALWKFSANNSSKDTRPLLCFKADTGRIRALSWAPLESDSGNTNIIIVAGDKGLKFWDLRDPFRPLREYHVGSGVHICSVDWLPEPRFIVISCDDGTLKILGLPKAAYDAPVTGNLLVGTKQQGFHSFTRSRLGIWSVQASRITGMVAYCGVDGTAARFQMSSKMYNDPLRTRAPHFLCGSFSEDESGISVVTPVPNTPFRMIYSGKQWRDAIPRSPHGLDKRMIEQSDEQPLALCYGDDPNVEGGSDDELASQSSKTKTKSTSKKPEAAEEEATRLRQKFEKLPPKILSIHRIRWNMNKGSERWLCYGGAAGLVRCQQIDL

SEQ ID NO: 6383 - protein, 114 aa, Arnica chamissonis
MGDTPKTSRGFKSRSNQEKRAKGQISKCQTPPKQSSEGTLKNNDASLETQTSQELVCIDNDSKIEEENVKEEETEVFPPKIVAMHRATWNMNKGSERLVCYGGAAGIVRCQEIR

SEQ ID NO: 6384 - protein, 269 aa, Cephalotaxus harringtonia
MYILSMDDGTLHILTLCKVALDTPVTGRAFRGTQFQGLQSYYCSSFTIWSVQASRLTGLVAYCSVDGSVLHFQLTAKAVEKDKMRHRTPHYTCGSFVEEGSRTFKIISPTILTPVPMKKSLNEWSDTPRSIRGFLSESNQALRTNIHAAAENKCIQSGSFELVAVADEDTVTPSKKRIAKKSKKATIGKHSTKHMKKDVGNLSLVPAGQCSSTGAEGIGCGGFEKYPSKQVSVHRVRWNYNPGSERWLCYGGAAGIVRCQEITSVFAVQ

SEQ ID NO: 6385 - protein, 61 aa, Pinus pinaster
PSKSKITKKSKKTTSGKHSTADVTEDMEDLPLVPSVNAGRCSSGVEGLRDMTSPIEKSLQN

SEQ ID NO: 6386 - protein, 909 aa, Pinus taeda
MVMTMEEETEVKARDRGRGRGRGRGRGRGKGRGKKNVTFDDEDEENMVGEDMNSMDSWEHDHELRKTKERKRGKSKEKPPAVAVARFDLSIDNHLRFCANYFPEFGRLEEGGGKFKSLERIQSGITFVRDWQSYCRYGVDSKLVKFACETKDSEIKDNSLSAVMPQFSAAAVPQWDRGPTNNPNLSNSRNDFVLNVGGSVWALDWCPKGNQGAGNQINCEYLAVGAHPPGCSYHRLGVPVAGKGVVQIWSIFNTNVSVKDPPSKRQKVRAKKQMDKSEPDYEDDKVSTVPVLFKEHVVGQYSVPEPVEVPEKSVHEGSSRIELVEKIEENGNLENTPTTISIDCRYQEMTDNDAEWTAQKSRKKMKDKARSKLIDDTGVLVPENMVEKSESCMDIVAANDIIRKDIGSIGIRAKSSAVSLAVDETSIIPTAEFGLPRMVLCLAHDGEIAWDVKWQPLTDKDHRNQHRLGFLAVLLGDGSMQVWEVPVPSAVNFLFTSSYARGGLDPRFVKLDPVFKCSKLQSGGRQSIPLTLEWSTSAPHDLLLAGCHDGMVAVWKFSPKASSQDARPLICFIADTLAIRTLAWAPSDGDSESKNVFVTGGHGGSLRFWDLRDHFRPLWDLHLSRGIILSLDWLHEPRCIILSMDDGTLRLLSLTKAALDTPVTGRSFCGTQFQGLQSYYCSSFSIWSVQVSRLTGLVAYCSVDGSALHFQLTQKAVDKDKMRHRTPHYICGAFVEEGSKAFKVISPSTLTPVRMKKSLNEWSDTPRSIRGFLSESNQAIRANIQAADNKYMRSSSMELAVVSDADTITPSKSKITKKSKKTTSGKHSTADVTEDMEDLPLVPSVNAGRCSSGVEGLRDMTSPIEKYPSKLVAVHRVRWNFNKGSERWLCYSGAAGIVRCQEITSVFSA

SEQ ID NO: 6387 - protein, 70 aa, Podocarpus macrophillus
MWMVWPWFLQINTVIQVLMRLVGSKSTLQKLVAVHKIRWNFNRGSERWLCYGGAAGIVRCQEITSAIGMQ

SEQ ID NO: 6388 - protein, 155 aa, Pseudotsuga menziesii
MKKSLNEWSDTPRSIRGFLSESNQAIRANIQAADNKYMRSSSMELAVVSDADTITPCKSKVTKKSRKTTSGKHSTADVTEDMDDLSLVPSANAGRCSSGVEGLRDVTSPIEKYPSKLVAVHRVRWNFNKGSERWLCYSGAAGIVRCQEITSVFAT

SEQ ID NO: 6389 - protein, 149 aa, Sciadopitys verticillata
KKSLNEWSDTPRSIRGFLSESNQALRTNIQAAAENKYIQSGSSELVAVSDGDTVIPSKYTIPKKSKKGKSGKRSKTEDVGDLPMVSAGQCSSSGVEGIGCGWIEKYPSKQVAVHRVRWNSNPGSERWLCYGGAAGIVRCQEITSVFSME

SEQ ID NO: 6390 - protein, 185 aa, Artemisia annua
MTGMVAYCCSDGKVIHFQLTARALGKDHHRNREPHYLCGSLSVEESTLTVFSPLPNVPFTLKRSLNEWGNTPRSKRGFLSHCNQEKRAKKEISKCQTTGNNSDSEGTMVTAQKKKTSQKTITSKALVCIDDDDKSEEENVIEEEKETLPPKIIAMHRVRWNMNKGSERLLCYGGASGIVRCQLIR

SEQ ID NO: 6391 - protein, 591 aa, Manihot esculenta
MEEEEVLEGNGAGIRVSLFDYSVENHFKAMDTISKLCEEAESDSLQEAEIQRLSSSITFLKEWRQFKYQPRVVRFACETENSQEKCFLGDTNLPQFSSATVPEEGLHGDAASVEPSKDFVMYVGGSVWALDWCPRFHDRPASCVKCEFVAIAAHPPDSYYHKVGTLLTGRGLVQIWCILNVSENDEAPPSLKKPKRGHHSSHSVGDKSSLIIKGPKGRPSKKQVESPNGNGTEENSIQFKRPRGRPRKQQIEKPPSDEATKESSTQFKRPRGRPRKKEINESLDNSDCKNQCVEALAVQYPEDSSQLLAIEWVSGNTQEQTIQENKGRKRKASTKALSACNSAAETTGSRRQKTKASAAGKCAGETCPPLLTQNDDDQSSPAIHQIHENTIQDPAVLNCSSDNVPQENNSDSFSIPKDIALPRLVLCLAHNGKVVWDVKWQPCHSSDSKCQHRMGYLAVLLGNGTLEVWDVPLPHILKVIYSSSHREGTDPRFVKLEPVFRCSIAKCGEIQSIPLTVEWSTSCPHDYLLAGCHDGTYLLPNYNNTRPLLRFSADTLAIRAVAWAPVGRSYPRECKCHSYCWTWRAEVLGLT

SEQ ID NO: 6392 - protein, 136 aa, Ricinus communis
MRSLLESNQTKRANSSKANAPAADNQLLALCDVNDPGVQSESDESLAAFRSRTKSKSKSISKKMTGEDLALVCIDEGQNNRWQKEIVKAEVANEIEVIPPKIIAMHRVRWNINKGSERWLCSGGAAGIVRCQEIIL

SEQ ID NO: 6393 - protein, 847 aa, Ricinus communis
MVKEAEESLERNNDTEIRVSLFDNSIDNYLNAIDKISKLCGETVTDSPEIQQLSSSITFLREWKYYYCEPKTIRFSCELESCQEKGFLGEVNLPQFSSVAVPRKEKLYGGSASSESSNDFIMHVGGSVWALDWCPRTHERPADHIKCEFVAVAAHPPDSYYHKIGASLTGRGIVQIWCILNVSGNDEETPLPLKKSKQGTQNEDACNGESALVKRPKGRPRKKQLDESSNDEATKQNCTQFKRPRGRPRKKQIEEALNAEATNESLTKLKKTRGRPRKKANDDLDNIFCNNQYVQALAVEYPEDSSQVLAIEGISENTQRQIIGKNKGKKRKSCTEAFVQDPAVLNCGLDNVSGEINTGFCSIPKDVALPRVVLCIAHDAKVVWDVKWQPCYGSDSKCQHRMGYLAVLLGNGFLEVWDVPLPHVTKVIYSSSNREGTDPRYVKLKPVFRGSIAKRGEIQSIPLTVEWSTSYPHDYLLAGCHDGTVALWKFSASGLSGDTRPLLCFSADTVAIRAVAWAPAGSDQESDNVIVTGGHGGLKFWDIRDPFRPLWDLHPAPKFIYSLDWLPDPRCIILSFDDGTLRLLSLVKAAYDAHVNGQPSVGPKQQGIQNIFNFSSFAIWSVQVSRKTGLAAYSSADGTVCRFQLTTKAVEKSPSRHRTPHFMVGSLSKDEAAITVNIPLPDTPLTLKKPVNTVGDNPRSMRSLLESNQTKRANINKANALAADNQLLALCDVNDPGVQSESDESLAAFRSRTKSKSKSISKKMTGEDLALVCIDEGQNNRRQKEIVKAEVANEIEVIPPKIIAMHRVRWNINKGSERWLCSGGAAGIVRCQEIILSDTDKLLARKR

SEQ ID NO: 6394 - protein, 270 aa, Centaurea maculosa
REQVLGSRDPFRPLWDINPNERIINSLDWHPDPRCVVLSFDDGEIQIISISRSACDVPVTGGSLVSAHKHASHSYHCSLSSITSIQVSRLTGMVAYCCSDGKALYFQLTIKAAEKDPSRNREPHYLCGAVTMEESTLTVLSPLPNVPFPMKKSSNKWDDTPRSRRGYKSRSNQEKRAKEQMLKCQPPEEQQPLALCYDGNDGNGGGSDSGSDESSSKKGKKEREEEVEVLPCKKVGMHGVRWNTNKGSERWLCYGGAAGILRCQEVSTPY

SEQ ID NO: 6395 - protein, 70 aa, Castanea mollissima
PEDDLALVCRDEEPPNTQGKENGKAEARTIEVFPPKIVAMRRVRWNMNKGSERWLCYGGEAGVVRCQEIV

SEQ ID NO: 6396 - protein, 120 aa, Cryptomeria japonica
NKYIQSGSSELVAVSDEYNVTPSKNRIAKKSKKVTSGKHTTKHMKESMGDLSLVPAGAGQCHSSGVEGIGCSRIEKYPSKQVSIHKVRWNSNPGSERWLCYGGAAGIVRCQEITSVFAVQ

SEQ ID NO: 6397 - protein, 660 aa, Mimulus guttatus
SSSTKLIIGVEDEGDVEFNTDAPISQSFNRKRKTINENPAQLPPADGPPEIAVSEFEYSVENHFKYVDKVAKLCSHPETLDPPDQADIKRISNSITFLREWRDFNYGPRIVRFACQYSSKEKDVIGGATLHQFSSASVPKKETRNGDESGTEFSKDFVMHVGGAVWALDWCNCHLVLSCLLSHLLSVASSKLLIGFVAVAAHPPESSHHKIGAPLTGRGAIQIWCLLTLYVKEDAASKGTKKPKPISQELATVNDPNKVLKPRGRPRKKPITDTVEKIDRPRGRPRKNPINDTRESALVNPLVSATSFGLDSMSPPKNVGSCDANTFKHSIPVDVELPRMMLCLAHNGKVAWDLKWRPVDVHGPASRNIMGYLAVLLGNGALEVIPLTLEWSVSAPYDTIVAGCHDGVVALWKFSATDSLTETRPLLSFSADTGPIRTLAWAPNQTDLESANVIVTAGHKGFKFWDIRDPFRPLWDHAMQGVTYGLSWLRDPRCVFGSVDDGTLWFHRLENTASDIPITGKCVAAATKQGFHSFDCSSFSIWNVQASPLTGVVAYCGEAGTTLCFQPTARSVKDPSRNRRTHLLCGSLLEEEDALIVATPSTSTSHSRRYPGMKREVFPGKNVAIHRVRWNANKGSENWLCYGGAAGLLRCQQIDSSLLQ

SEQ ID NO: 6398 - protein, 308 aa, Tropaeolum majus
IPLTLEWSPLSRPDFILVGCHDGTVAMWKFSPSSSPKDTRPLLRFSADTAPIRAISWAPAESDPENANVILTGGQGGLKFWDIRDPFRPLWDITMTRFIYSLDWLPDPRCVVISFDDGTLRIISLANVLNDVPVPGKRCTGAKPTLSLFNYSSFATWSVQVSRQTGVAAYCSADGTVLCFQLTVNAVEKDSRYRPSHFLSWFLTEEESTYIVNTPLPNNPLKMKKMPISESGEAPRSMRSLLADSNQTKNINNKKPNNTQARDTQHLGVCYDSDPTVEEQRGHKKNQKTKDVNAEVKEKDKKETRMKH

SEQ ID NO: 6399 - protein, 665 aa, Quercus alba
RSCCSKDFVIYVGGHVWALDWCPRICEMPDYHNKCEFIAVAAHPPGTSYHKMGAPLTGRGVIQIWCLMNVGVNEEEVPPSLAKPKQGTKNNGAVTDDSTLSKRPRGRPRKRPVEDTTQSKRPRGRPRKNLIEQSLDNLAVQALAVKHAEDSLESHAVDEVPGNAKEGSVQEDTGKKHKRQKRAVSACKLALETPMQSRRLKHKKRAVSHSDNTSPLLLTQNEDMGSSVTNNQIQHYSGQELAASDNVSDKGSLGTSSASSLISKDVALPRVVLCLAHNGKVAWDVKWRPSNACQSKCKHRMGYLAVLLGNGSLEVWEVPLPRTMKVIYSSVHQEGTDPRFVKLEPVFRGSLLKCGGIQSIPLTVEWSASPPHDYLLAGCHDGTVALWKFSASCSSEDTRPLLCFSADTVPIRALAWAPLESDPESANVIVTAGHGGLKFWDLRDPYRPLWDLHPVPRIIYSLDWLSNPRCVILSFDDGTMRILSLLKAAYDVPVTGKPFGGTKQQGLHSYYCSSFAIWSVQVSRITGMAAYCTADGTVLRFQLTSKAVDKDPSRNRTPHFLCGSLTEEESLITINTPVPNTPFPLKKSLNKSGDTPLSMREFSSEPQHVKRANDKMAKGPSTDAKTLALCYGDDPGTESGTEEALTCPKSKKRPNSAIKKIQRMT

SEQ ID NO: 6400 - protein, 594 aa, Cajanus cajan
MVQIVRMNLCLLMFQVLEDSTKLLSPDVAHDNEYAMQQYSVTKQRHAKEAVSACNTISTTLVKSSGLKNNHTEEIYGHDISQPVQYENEANHQPNCTSELEARPATCSIPEDITLPRLVSCLAHNGKVAWDVKWRPTNISDSFGKYRMGHLAVLLGNGSLEVWEVPLPHVMREIYMHREGTDPRFIKLEPVFKCSMLKRGGLLSIPLTVEWSVKPPHDYLLAGCHDGMVALWKFCTNSSSKCEDSKPVLCFGADTVPIRTVAWAPFEGDPESPNIVVTAGHEGLKFWDLRNPFRPLRSLHPAPRMIYSLDWLSNPSCIVMSFEDGTMRTISLVKAANDLPVTGEIYSGKKQFGLHGSSYSSFAIWSVQVSRITGMVAYCGTDGAVFRFQLTTKEVETDHVRSRSPRFLCGLVTEEDSTIVINTPVSNTPFLWKKPQDKGRYAESFRDLLSKTNASKSANNQMAETPNSDSQTLAIGAGENAGLEVVSVEALSSVKQPKRPKLNSGSKKKTVEKPDLVCKDDDDVSAMTPGTDDEKSDFGNIPEVFPPKMAALHRVRWNMNKGSEKWLCFGGASGLVRCQEIVYSHIDKKLALKR

SEQ ID NO: 6401 - protein, 311 aa, Pinus taeda
AGGHGGSLRFWDLRDHFRPLWDLHLSRGIILSLDWLHEPRCIILSMDDGTLRLLSLTKAALDTPVTGRSFCGTQFQGLQSYYCSSFSIWSVQVSRLTGLVAYCSVDGSALHFQLTQKAVDKDKMRHRTPHYICGAFVEEGSKAFKVISPSTLTPVRMKKSLNEWSDTPRSIRGFLSESNQAIRANIQAADNKYMRSSSMELAVVSDADTITPSKSKITKKSKKTTSGKHSTADVTEDMEDLPLVPSVNAGRCSSGVEGLRDMTSPIEKYPSKLVAVHRVRWNFNKGSERWLCYSGAAGIVRCQEITSVFSA

SEQ ID NO: 6402 - protein, 85 aa, Rhizophora mangle
KTKAKTKRSLKPKQEKLGEDRALILRDEEQDNVPKKEGEMGGAGNEIKVIPPKLVAIHSVRWNMNKGSERWLCSGGAAGIVRCQE

SEQ ID NO: 6403 - protein, 189 aa, Picea glauca
  misc_feature (127)..(127): Xaa can be any naturally occurring amino acid
KMRHRTPHYICGAFVKEESKTFKVISPSTLTPVRMKKSLNEWSDTPRSIRGFLSESNQAIRANIQAADNKYMRSSSMELAVVSDADTITPSKSKITKKSKKTTSGKHSTADVREDMDDLPLVPSMNXGRCSSGVEGLRDMTSPIEKYPSKLVAVHRVRWNFNKGSERWLCYSGAAGIVRCQEITSVFTA

SEQ ID NO: 6404 - protein, 517 aa, Triticum aestivum
  misc_feature (1)..(2): Xaa can be any naturally occurring amino acid
  misc_feature (13)..(13): Xaa can be any naturally occurring amino acid
  misc_feature (48)..(48): Xaa can be any naturally occurring amino acid
  misc_feature (95)..(95): Xaa can be any naturally occurring amino acid
  misc_feature (196)..(196): Xaa can be any naturally occurring amino acid
XXQKVDRDEENEXAQSDVADKFAQKLAKDTSLTSWHSGFHVSLDMLPXYIHMRVAESILFAGKAIRVLRNPSPGATLLEPTNQSQTLKGSHRMQXFTGGSGALKELPNFSNISAEELLPQAEADKVDAMLKQLKHASEFHKRLFESAVSSIRTIAANHLWQLVVVRADLNGHLKALKDYFLLAKGDFFQCFLEESXQLMRLPPRQSTAEADLIVPFQLAALKTIGDEDKYFTRVSLRMPLFGMKSSTSQKDLQKSNTSDISLHGKASSELALDGWHSIALEYSVDWPLQLFFTPDVLSKYRKVFQYLIRLKRTQMELEKSWTAVMHQDHVDFSDYCKDRKNSSATQLRRLRTKPFWRVREHMAFLIRNLQFYIQVDVIESQWNVLQTHVQDSHDFTELVTFHQDYLSALISQSFLDIGSVSRILDSIMKLCLQFCWSIEQYETGSNMFEIDHITEEFNKKSNSLYTILRSSRLAGSQRAPFLRQFLMRLNFNSFFETTARGVMNSGRLRPGTASTQL

SEQ ID NO: 6405 - protein, 251 aa, Saccharum officinarum
PFESAVGSIRTIAANHLWQLVVVRADLNGHLKALKDYFLLAKGDFFQCFLEESRQLMRLPPRQSTAEADLMIPFQLAALKTIGEEDKYFTRVSLRMLSYGMKSSTSQKDLQKPNASELSSQGKATSELALDGWDSIALEYSVDWPLQLFFTPDVLSKYRKVFQYLIRLKRTQMELEKSWAAVMHKDHADFSDYWKDRKNNSATQLRRQRSKPLWRVREHMAFLIRNLQFYIQVDVIESQWNVLQISCARFT

SEQ ID NO: 6406 - protein, 263 aa, Panicum virgatum
  misc_feature (256)..(256): Xaa can be any naturally occurring amino acid
  misc_feature (259)..(259): Xaa can be any naturally occurring amino acid
AEELLPLAEADKIDAMLKELKHSSEFHKWLFESAVGSIRTIAANHLWQLVVVRADLNGHLKALKDYFLLAKGDFFQCFLEESRQLMRLPPRQSTAEADLMIPFQLAALKTIGEEDEYFTRVSLRMLSYGMKSSTSQKDLQKPNALELPSQGKAASELALDGWDSIALEYSVDWPLQLFFTPDVLSKYRKVFQYLIRLKRTQMELEKSWAAVMHKDHADFSDYCKDRKNGSATQLRRQRSKPLWRVREHMAFLIRNXSFXSRLM

SEQ ID NO: 6407 - protein, 489 aa, Pennisetum glaucum
DTSLASWHTGFHVSLDMLPEYIHMRVAESILFAGKAIRVLRNPSPGAMLQEPVSQSQNSKGSHRIQSFIGGSGAPKGMPNFSSISAEELLPQAEADKIDAMLKELKHSSEFHKRLFESAVGSIRTIAANHLWQLVVVRADLNGHLKALKDYFLLAKGDFFQCFLEESRQLMRLPPRQSTAEADLMIPFQLAALKTIGEEDKYFTRVSLRMLSYGMKNSTSQKDLQKPNASEVPSQGKAASELALDGWDSIALEYSVDWPLQLFFTPDVLSKYRKVFQYLIRLKRTQMELEKSWAAVMHKDHADFSDYCKDRKNGSATQLRRQRSKPLWRVREHMAFLIRNLQFYIQVDVIESQWNVLQSHVQDSHDFTELVSFHQEYLSALVSQSFLDIGSVSRILDSIMKLCLQFCWSIEQYDTRPNISEIDHITEEFNKKSNSLYTILRSSRLAGSQRAPFLRQFLMRLNFNSFFETTARGVMNSGRLRPSSVSAQL

SEQ ID NO: 6408 - protein, 103 aa, Triticum aestivum
HASAHASARCSFMNFARNAMCLECGGDRPKKMLTGGEWECPQCEFYNYGRNMSCLRCACKRPATTASAGAGLGGVAELLSVTNAGRSEIERGVGGAMRRQKGA

SEQ ID NO: 6409 - protein, 178 aa, Triticum aestivum
NTNYSQGSFNEGRDTSTYNQGSYSTQPSYTPGYSNHSNSNAWSSNNNQNRSGSHPDSRVATSGIGSTNPNQATGYSSYGGGGYTGKSLEGSAVKDPDPLDMSEEAKAERWFRRAAQIKDISELANIPDEDFPEIMPMRKGVNRFVVSKRKTPLERRLTSPQYRRNLPIVSSEPDKDAS

SEQ ID NO: 6410 - protein, 295 aa, Avena sativa
NYQHPQQPHDVSNRSGGTSNTDAWNTNYSHGRFNDGRGVSSNYQHQQQPREVGDRSGETSNTDAWNTNYSQGNFNDGRGGSSNYQHQMQPHDVGGRSSGTSSTHALDTTYSQGSFNEGRGGSTYNGGSYSAQPSYTPGYSNNSTNNAWSSSNNSNNWSGSQPDNSTATSGSASNNPNQAMGYSSYGGRGYTGKSLEGSAVRDPDPLDMSEEAKAERWFRRAAQVKHIDDLVNIPDEDFPEIMPMRKGVNRFVVSKRKTPLERRLTSPQYRRNLPVVSSEPDTHGYNSTPDWNNKQ

SEQ ID NO: 6411 - protein, 318 aa, Triticum aestivum
  misc_feature (147)..(147): Xaa can be any naturally occurring amino acid
MIELDCSSSRSVPFSSHCCRKTMKRKKRKRNEEKINAPSYIATHTILSYYEKEKTEGDGHSIDDIGNLADDSTKGNNDADWLLGNGDDATVEQILVSIQSVQDRVCSLRSDLKKAMAKKSKGLLLKVNTQVNGAQSSNCSHGKGKVXEMPEISPQDASDCDMGDTDMPDSAVSSYGEANNMDIFESTMNLLSVEDPDKIGELHQTSEDVLIDNQPAEEGYQNFEVISHPCQRLRVSVKREQVPVKRETVAHSEDESVAAPMAVVKEEGGTTRMGLQGILKPCYTGKRKGRRPKILRRGGSSSALSSWRSARTRKKRKS

SEQ ID NO: 6412 - protein, 221 aa, Avena sativa
LAATHRRAVVAAASSRPPPPPSPERGDEDEEEEQEVERAMGMDGGIPGTSGELLRRVSSRAYGMRRHLMESLDSLAYDVLETNPWREQPKPVYVLARRDNQLCTMKTRRNRSEVERELGMLFSKGGGSRVGTKSKYSGSKFSMLVEDVTEGVLVFEDEDDAVKYCDLLQGCEGIAEIEASSVFNLCRQMKALAVLFRRGGTPPTPQSLEHDLRARNRSLED

SEQ ID NO: 6413 - protein, 225 aa, Saccharum officinarum
PRLAAAHRRAVVATAASPRPRPPPPPEGDGDEQEVDRAMGMDGGIPGTSDEFLRRVSSRAYGMRRHLMESLDSLAYDVLETNPWREDSKPVYVLARSDNHLWTMKTRRSRNEVERELGKLFSKGGGSGVGTKSKYSGSKFDMVVEDIREGVLIFEDEDDAVKYCDLLQGGGQGCEGIAEIEASSVFNMCRNMKALAVLFRRGRTPPLPQSLERDLRARKRSPLED

SEQ ID NO: 6414 - protein, 193 aa, Pennisetum glaucum
GQEVERAMGMDGGIPGTSGEFLRRVSSRAYGMRRHLMESLDSLAYDVLETNPWREDSKPVYVLARSDNNLWTMKTRRSRNEVERELGMLFSKGGGSGVGTKSKYSGSKFNMVVEDVREGVLVFEDKDDAVKYCDLLQGGGQGCEGIAEIEASSVFSMCQKMKALAVLFRRGGTPPLPQSLERDLRARRRSLED

SEQ ID NO: 6415 - protein, 84 aa, Triticum aestivum
MVVEDIREGVLIFEDEDDAVKYCDLLQGGGQGCEGIAEIEASSVFNMCRNMKALAVLFRRGRTPPLPQSLERDLRARKRSPLED

SEQ ID NO: 6416 - protein, 260 aa, Zea mays
MAAPSSSLTPPPPAAAVASTTLSGNLTASSLLSITPPRPRLAASHRRAVVAAAASPRPPPTPEGDGDEQEVERAMGMDGGIPGTSGEFLRRVSSRAYGMRRHLMESLDSLAYDVLETNPWREDSKPVYVLATSDNHLWTMKTRRSRNEVERELGKLFSNGGGSGVGTKSKYSGTKFNMVVEDIREGVLVFEDEDDAVKYCNLLQGGGQGCEGIAEIEASSVFSMCRKMKALAVLFRRGKTPPLPQSLERDLRARKRSLED

SEQ ID NO: 6417 - protein, 121 aa, Panicum virgatum
MKTRRSRNEVERELGMLFSKGGGSGVGTKSKYSGSKFNMVVEDIREGVLVFEDEDDAVKYCDLLQGGGQWCEGIAEVEASSVFSMCQKMKALAVLFRRGRTPPMPQSLEHDLRARKRSLED

SEQ ID NO: 6418 - protein, 140 aa, Saccharum officinarum
MGFPQRGAEDLISICSCHKKIKSGAEGYICPRCKVNVCELPTECRTCGLTLVSSPHLARSYHHLFPVAPFDEVTPVPNRIQRGGQICFSCQQSLFNPDGQSNLHVRCPKCNQHFCLDCDIYIHESLHNCPGCESQRSIAS

SEQ ID NO: 6419 - protein, 167 aa, Setaria italica
HFKELLLEHAPPPPAIAEYAAANLIKMGFPQRGVEDLISICSCHKKIKSGAEGYICPRCKVNVCELPTECRTCGLTLVSSPHLARSYHHLFPVAPFDEVSSVPNRIQRGVQNCFGCQQNLFNPDGQTSLHVRCPKCNQHFCLDCDIYIHESLHNCPGCESQRSFSSL

SEQ ID NO: 6420 - protein, 206 aa, Cenchrus ciliaris
  misc_feature (166)..(166): Xaa can be any naturally occurring amino acid
  misc_feature (202)..(202): Xaa can be any naturally occurring amino acid
KCKKSKIRCSVIGLAAEIFICKHLCEETGGSYTVALDESHFKELLLEHAPPPPAIAEYAAANLIKMGFPQRGVEDLISICSCHKKIKSGAEGYICPRCKVNVCELPTECRTCGLTLVSSPHLARSYHHLFPVAPFDEVSSVPNRIQRGVQNCFGCQQNLFNPDGQXSLHVRCPKCNQHFCLDCDIYIHESLHNCPGCESQRXLSSQ

SEQ ID NO: 6421 - protein, 351 aa, Pennisetum glaucum
LLLRSAAAAAARIQKGLIRYLYIVIDLSRAASEMDYRPSRMAVVAKHAEAFIREFFDQNPLSHVGLVTIKDGISHRLTEIGGSPESQINALIGKLECSGDSSLQNALELVHGYLDQVPSYGHKEVLILYSALNTCDPGDIMETIEKCKKSKIRCSVIGLAAEIFICKHLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFPVAPFDEVSSAPNRIQRGVQNCFGCQQNLFNHDGQTSLHVRCPKCNQHFCLDCDIYIHESLHNCPGCESQRSFQSQ

SEQ ID NO: 6422 - protein, 129 aa, Panicum virgatum
YLYLLCHKKIKSGAEGYICPRCKVNVCELPTECRTCGLTLVSSPHLARSYHHLFPVAPFDEVSSVPNRIQRGVQNCFGCQQNLFNPDGQTSLHVRCPKCNQHFCLDCDIYIHESLHNCPGCESQRGFSS

SEQ ID NO: 6423 - protein, 93 aa, Theobroma cacao
MAPALSLSVSHLPVCKSQDFSKDTCLPKGTNRENPSAKIASDVKLSKRKLLSSTALGLIGGLSVAQPIQRSQLKAHQIECHIQDSCSTWTKVL

SEQ ID NO: 6424 - protein, 1155 aa, Populus trichocarpa
MSPALSLSLPHIPICKSQDLANGVQIPKSTNRDSPSLKTPLDIKLSKRELLNATAVVLLSEGLSVAKPARAAEPESPVTSTSSRMSYSRFFEYLDEGAVRKVDLFENGTVAIAEIFNPTLEKIQRVKIQLPGLPQELLRKLEEKNVDFAAHPTEPNWTAALLDSLGNLAFPLILLGSLLLRTSSTNTPGGPGLPFGLGRSKAKFQIEPNTGVTFDDVAGVDEAKQDFQEIVEFLKTPEKFAAVGARIPKGVLLVGPPGTGKTLLAKAIAGEAGVPFFSLSGSEFIEMFVGVGASRVRDLFNKAKANSPCIVFIDEIDAVGRQRGTGIGGGNDEREQTLNQLLTEMDGFSGNSGVIVIAATNRPEILDSALLRPGRFDRQVTVGLPDVRGREEILNVHSKNKKLDKGVSLSVIAMRTPGFSGADLANLMNEAAILAGRRGKYKITLKEIDDSIDRIVAGMEGTKMTDGKCKTLVAYHEVGHAVCATLTPGHDLVQKVTLIPRGQARGLTWFIPGEDPTLISKQQLFSRIVGGLGGRAAEEVIFGESEITTGAAGDLQQITQIAKQMVTMFGMSELGPWALTDPAAQSSDVVLRMLARNSMSEKLAEDIDSSVRNIIERAYEIAKEHIRNNREAIDKLVEVLLEKETLSGDEFRAMLSEFTDIHVDKIDRTPNHCLSLLKLSSSVKHVSQIHAQILVSGLQQDTNLLTELIRFCSLSPSKHLSYAHSLLYNSLDSLPPWNFLIRGYASGDAPKNAIRVFHRMRKEGVGPNNFTFPFVLKACATCLALEEGKQVHADIFKFGLDCDVYVNNNLVHLYGSCKRIWDACKVFDEMPVRSIVSWNSVITACVQNLWLGDAIWNFVKMKDFGFEPNETTMVIMLSLCAQIGNLSLGRWIHSQVIERGMTLNCQLGTALVDMYAKSGDLGYAKLVFDRMEKKNVWTWSAMILGLAQHGFGKEGLELFLKMKESVSICPNYVTFLGVLCACSHAGLVDEGFRYFYEMEHRHGIRPMVIHYGAMVDILGRAGNLEEAYNFLMDVPFQPDPILWRTLLSACNIHNANVSDGLVDKVRKKLLELEPRRSENFVIIANMYADAGMWETATNVRRTMRDGGLKKIGGESCIVLEGSIHQFFSGCSKDDHESIELLLDGLNLNMKMVNSL

SEQ ID NO: 6425 - protein, 420 aa, Glycine max
RSKAKFEMEPNTGVTFEDVAGVDEAKQDLQEIVEFLKTPEKFSAVGAKIPKGVLLVGPPGTGKTLLARAIAGEAGVPFFSLSGSEFIEMFGGVGASRVRDLFSKAKQNSPCLIFIDEIDAVGRQRGTGIGGGNDEREQTLNQLLTEMDGFTGNTGVIVIAATNRPEILDSALLRPGRFDRQVTVGLPDERGREEILKVHSNNKKLDKDVSLSVIAMRTPGFSGADLANLMNEAAILAGRRGKDKITMKEVDDSIDRIVAGMEGTKMTDGKSKILVAYHEIGHAVCATLTPGHDPVQKVTLVPRGQARGLTWFIPGEDPSLISKKQLFARIVGGLGGRAAEEVIFGETEITTGAAGELQQITQIARKMVTVFGMSEIGAWALTDPAVQSSDVVLRMLARNSMSDKLAEDIDNSVRQIIEAA

SEQ ID NO: 6426 - protein, 1158 aa, Prunus persica
MSPALSLSVSLSPLCKSQDISKETHLPKNPNRENPCQSTHSNFKFSRRSLLNSTTLDLVGAGALSVSKPARAEPKPEPESPVASTSSRMSYSRFLQYLDEDAVKKVDLFENGTVAIAEIFNPTLDKIQRVKVQLPGLPQELLRKMKEKNVDFSAHPMEINWLPAVLDLLGNFAFPLILLGTLLFRASSTNTPGGPNLPFGLGRSKAKFQMEPNTGVTFDDVAGVDEAKQDFQEIVEFLKTPEKFSAVGARIPKGVLLVGPPGTGKTLLAKAIAGEAGVPFFSLSGSEFIEMFVGVGASRVRDLFNKAKANSPCLVFIDEIDAVGRQRGTGIGGGNDEREQTLNQLLTEMDGFSGNSGVIVIAATNRPEILDSALLRPGRFDRQVTVGLPDIRGREEILKVHSNNKRLDKDVSLSVIAMRTPGFSGADLANLMNEAAILAGRRGKNKITMKEIDDSIDRIVAGMEGTKMTDGKSKVLVAYHEVGHAICATLTPGHDPVQKVSLIPRGQARGLTWFIPDEDPALISKQQLFARIVGGLGGRASEEVIFGEPEITTGAAGDLQQITQIARRMVTMFGMSEIGPWALTDPATQSSDVVLRLLARNNMSEKLAEDIDLSVRHIIESAYELAKNHVRNNREAMDKLVEVLLEKEILTGDEFRAILSEFTDISVAKLDRKSQCLYLLNLCFTFKQLSQVHAQIQVSGFQRDHFLLTQLIRFCALSPSKNFNYARTLLDHSESSPPSSWNFLIRGYASSDTPREAIWAFRAMLGRGIRPNQLTFPFLIKSCASAAALKEGRQVHVGVVKCGLDCDVYVQNNLVHFYGACKKIKDAQRVFDGMSVRTVVSWNAVLTACVENFWLDEGIGYFVKMRDCGFEPDETTMVVMLNASSELGNLSLGKWVHSQVIEKGLILNCQLGTALVDMYAKSGALVYARLVFDRMELRNVWTWSAMILGLAQHGFAKEALELFPKMLNFSVRPNYVTFLGVLCACSHAGQVDDGYQYFHDMEHVHGIKPMMIHYGAMVDILGRAGRLNEAYSFIMSMPFDPDPIVWRTLLSACNTRDANDDEGVGNKVSEKLLELEPSRGGNLVMVANMYAEVGMWEKAANLRKVMKERRVKKTAGESCVELGGSIHKFFSGYDSRADYEGIYQLLDVLSLHMELVNM

SEQ ID NO: 6427 - protein, 438 aa, Mesembryanthemum crystallinum
FAAVGAKIPKGVLLVGPPGTGKTLLAKAIAGEAGVPFFSLSGSEFIEMFVGVGASRVRDLFKKATENAPCLVFIDEIDAVGRQRGTGIGGGNDEREQTLNQLLTEMDGFSGNSGVIVIAATNRPEILDQALLRPGRFDRQVAVGLPDVRGREEILKVHSSNKRLDKDVSLNVIAMRTPGFSGADLANLMNEAAILAGRRGKDRITIKEVDDSIDRIVAGMEGTKMTDGKSKMLVAYHEVGHAVCATLTPGHDPVQKVTLIPRGQARGLTWFMPNEDPTLVSKRQLFARIVGGLGGRAAEEVIFGEPEITTGAAGDLQQVTQIAKQMVTMFGMSEIGPWALTDPAVQQSDVVLRLLARNSMSEKLAEDIDASVRRIVDSAYEIAKQHIRNHREAIDKIVDVLLEKETLTGDEFRAILSEFVDISVNDSSRTSVRQLINA

SEQ ID NO: 6428 - protein, 685 aa, Arabidopsis lyrata
MKMASSSSALSLPLSNIPTCNKKSQEFQKPAPLSKSSHTHKPSLKTQTLHHKLTKRNLLSLTALGFTSSLGTVLAHPAKAEPEAPIEATSNRMSYSRFLQHLKENEVKKVDLIENGTVAIAEISIPALGKIQRVRVNLPGLPVDLVREMKEKNVDFAAHPMDVNWGAFLLNFLGNLGFPLILLGSLLLTSSSRKTPGGPNLPFGLGRSKAKFQMEPNTGITFDDVAGVDEAKQDFEEIVEFLKTPEKFSALGAKIPKGVLLTGPPGTGKTLLAKAIAGEAGVPFFSLSGSEFIEMFVGVGASRVRDLFNRAKANSPCIVFIDEIDAVGRMRGTGIGGGNDEREQTLNQILTEMDGFTGNTGVIVIAATNRPEILDSALLRPGRFDRQVSVGLPDIRGREEILKVHSKSKKLDKDVSLSVIAMRTPGFSGADLANLMNEAAILAGRRGKDKITLTEIDDSIDRIVAGMEGTKMVDGKSKAIVAYHEVGHAICATLTEGHDPVQKVTLVPRGQARGLTWFLPGEDPTLVSKQQLFARIVGGLGGRAAEDVIFGEPEITTGAAGDLQQVTEIARQMVTMFGMSEIGPWALTDPAVKQNDVVLRMLARNSMSEKLAEEIDACVKKIIGDAYEIAKKHVRNNREAIDKLVDVLLEKETLTGDEFRAILSEYTDQPLNTDDRVRIKDLISV

SEQ ID NO: 6429 - protein, 686 aa, Arabidopsis thaliana
MASSSSALSFPLSNIPTCSKKSQQFQKPASLSKSSHTHKPSLKTQILHHKFTKRNLLSLTTALGFTSALGTVLAHPAKAEPEAPIEATSNRMSYSRFLQHLKENEVKKVDLIENGTVAIVEISNPVVGKIQRVRVNLPGLPVDLVREMKEKNVDFAAHPMNVNWGAFLLNFLGNLGFPLILLVSLLLTSSSRRNPAGPNLPFGLGRSKAKFQMEPNTGITFEDVAGVDEAKQDFEEIVEFLKTPEKFSALGAKIPKGVLLTGPPGTGKTLLAKAIAGEAGVPFFSLSGSEFIEMFVGVGASRARDLFNKAKANSPCIVFIDEIDAVGRMRGTGIGGGNDEREQTLNQILTEMDGFAGNTGVIVIAATNRPEILDSALLRPGRFDRQVSVGLPDIRGREEILKVHSRSKKLDKDVSLSVIAMRTPGFSGADLANLMNEAAILAGRRGKDKITLTEIDDSIDRIVAGMEGTKMIDGKSKAIVAYHEVGHAICATLTEGHDPVQKVTLVPRGQARGLTWFLPGEDPTLVSKQQLFARIVGGLGGRAAEDVIFGEPEITTGAAGDLQQVTEIARQMVTMFGMSEIGPWALTDPAVKQNDVVLRMLARNSMSEKLAEDIDSCVKKIIGDAYEVAKKHVRNNREAIDKLVDVLLEKETLTGDEFRAILSEYTDQPLNTDGDVRIRINDLISV

SEQ ID NO: 6430 - protein, 569 aa, Ricinus communis
MSPALSFSLSRVPICKFQAFSKDTHLTRIGNKDDPSHKTSLDIKLSKRKLLCATASGLLSVASQSAKAEPDIPIASTSSRISYSRFLQYLDEGAVRKVDLFENGTMAIAEIFNPTLDKIQRVKIQLPGLPHELLRKMEEKNVDFAAHPMEFNWAPALIDLLGNFAFPLILLGSLLLRSSSTNTPGGPNLPFGLGRSKAKFQMEPNTGVTFDDVAGVDEAKQDFQEIVDFLKTPEKFSAVGARIPKGVLLVGPPGTGKTLLAKAIAGEAGVPFFSLSGSEFIEMFVGVGASRVRDLFNKAKVNSPCLVFIDEIDAVGRQRGTGIGGGNDEREQTLNQLLTEMDGFSGDSGVIIIAATNRPEILDSALLRPGRFDRQVTVGLPDIRGREEILNVHSKSKKLDKDVSLSVIAMRTPGFSGADLANLMNEAAILAGRRGKDRISLKEIDDSIDRIVAGMEGTKMTDGKSKILVAYHEIGHAVCATLTPGHDPVQKVTLIPRGQARGLTWFTPGEDPTLISKQQLFARIVGGLGGRAAEEIIFGESEITTGAAGDLQQVTEIAKQAYGNNIWHV

SEQ ID NO: 6431 - protein, 459 aa, Glycine max
MEPNTGVTFEDVAGVDEAKQDLQEIVEFLKTPEKFSAVGAKIPKGVLLVGPPGTGKTLLARAIAGEAGVPFFSLSGSEFIEMFGGVGASRVRDLFSKAKQNSPCLIFIDEIDAVGRQRGTGIGGGNDEREQTLNQLLTEMDGFTGNTGVIVIAATNRPEILDSALLRPGRFDRQVTVGLPDERGREEILKVHSNNKKLDKDVSLSVIAMRTPGFSGADLANLMNEAAILAGRRGKDKITMKEVDDSIDRIVAGMEGTKMTDGKSKILVAYHEIGHAVCATLTPGHDPVQKVTLVPRGQARGLTWFIPGEDPSLISKKQLFARIVGGLGGRAAEEVIFGETEITTGAAGELQQITQIARKMVTVFGMSEIGAWALTDPAVQSSDVVLRMLARNSMSDKLAEDIDNSNHIRNNRDAVDKLVDVLLEKETLSGDKLRAILSEFTDISSIKVERIPIRELIEA

SEQ ID NO: 6432 - protein, 347 aa, Nicotiana tabacum
  misc_feature (20)..(20): Xaa can be any naturally occurring amino acid
  misc_feature (25)..(25): Xaa can be any naturally occurring amino acid
  misc_feature (51)..(51): Xaa can be any naturally occurring amino acid
  misc_feature (147)..(147): Xaa can be any naturally occurring amino acid
MMKESRHLTNFSLKWMVSLXNTGVXVIAATNRPEILDQALLRPGRFDRQVXVGLPDIRGREEILKVHSNNKKLDKDVSLSVIAMRTPGFSGADLANLMNEAAILAGRRGKDKITSKEIDDSIDRIVAGMEGTKMTDGKNKILVAYHXVGHGVCATLTPGHDAVQKVTLIPRGQARGLTWFIPGEDPTLISKQQLFARIVGSLGGRAAEEIIFGEAEITTGAAGDLQQITQIARQMVTMFGMSEIGPWALTDPATQSGDVVLRMLARNQMSEKLAEDIDASVRHIIERAYEIAKNHIRNNREAIDKLVDVLLEKETLTGDEFRAILSEFTNIPSANINSKPIRELIEA

SEQ ID NO: 6433 - protein, 679 aa, Aquilegia formosa
MPVALSISASKLLISNFQYHSKDTNLQKNVSRENPSLGSLQDIKLSKRKLLQSLGLGLINGGVLAVQPTRAEPENQTDFTSSSTMSYSRLLEYIDEGKVKKVDFFENGTVAIAEIMNLGLNRTQRVRVQLNNLSEEVLLKRLKEKDVDFAAHPMEPNITAMLLDFLWNFGFPLFLVGSLLFRGSSMNNTPGGPNLPFGLGRSKAKFQMEPNTGITFDDVAGVDEAKQDFQEIVEFLKTPEKFSSVGARIPKGVLLVGPPGTGKTLLAKAIAGEAGVPFFSLSGSEFIEMFVGVGALRVRDLFNKAKMNSPCLVFIDEIDAVGRQRGTGIGGGNDEREQTLNQLLTEMDGFSGNSGVIVIAATNRPEILDSALLRPGRFDRQVTVGLPDIRGREEILKVHAKNKKLDKNVLIDVIAMRTPGFSGADLANLMNEAAILAGRRGKEEITTKEVDDSIDRIVAGMEGTKMTDGKSKILVAYHEIGHAICATLTPGHDPVQKVTLIPRGQARGLTWFIPGEDPTLVSKQQLFARIVGGLGGRATEEIIFGEPEVTTGATGDLQQITQIARQMVTTYGMSEIGPWALTDPAAQSSDVVFRLLARNNMSEKLAEDIDKSVRTIVNTAYEIAKSHIRNNREAIDKLVDVLLEKETLPGDEFRAILSEFVNTPLDKINKTSIRELITL

SEQ ID NO: 6434 - protein, 687 aa, Sorghum bicolor
MSPTTMSLTTTSRLPICRAQDVSKQAPGQKRAPPSSSKSSSDTAGFSRRRLLQSAGMGLGGLGLAVRDPARARAETAPALAPEEVTSNRMSYSRFLDYLNASAVRKVDFFENGTVAVVELDDPALAPSRVHRVRVQLPGLSAELVRKLRDRGVDFAAHPVEPNLGLVFLDVLLNFGFPLLFIASLIWRSITMNNPGAGGGPSLPFGLGKSKAKFQMEPNTGITFDDVAGVDEAKQDFQEIVQFLKSPEKFTAVGARIPKGVLLVGPPGTGKTLLAKAIAGEAGVPFFSLSGSEFIEMFVGVGASRVRDLFSKAKANAPCLVFIDEIDAVGRQRGTGIGGGNDEREQTLNQLLTEMDGFSGDSGVIVIAATNRPEILDAALLRPGRFDRQVSVGLPDVRGREEILRVHSSNKKLDPDVSLSVVAMRTPGFSGADLANLMNEAAILAGRRGKDRISVKEIDDSIDRIVAGLEGTTMTDGKSKLLVAYHEIGHAVCATLTPGHDAVQKVTLIPRGQARGLTWFLPGEDPTLVSKQQIFARIVGGLGGRAAEEVIFGDAEVTTGAAGDLQQVTQVARQMVTTFGMSEIGPWALMEPAAQSGDVVLRMLARNSMSEKLAADIDSAVKHIIDQAYEVAKEHVRRNRAAIDQLVDVLMEKETLTGDEFRAILSEHVDIGKEQRETAARTELVTA

SEQ ID NO: 6435 - protein, 327 aa, Gossypium hirsutum
VSKLGFGCMGLTGVYNDSVHEEVGISIIKHAFHRGITFFDTSDFYGPKTNEILVGKALKQLPREKVQLATKFGIEKMDSAGVTINGTPEYVRACIEASLKRLDVDYIDLYYQHRVDTNTPIEDTMSELKKLVEEGKIKYIGLSGASPETIKRAHAVHPITALQIEWSLWTRDLEEEIVPLCRELGIGIVPYGPLGSGFFAGRGVLETMPANSFLPTFPRFQEENLDKNKIIYLKVEKLAKKHGCSPAQLALAWVLHQGDDVAPIPGTTKIKNLDSNSDSLKVKLTEEDLKEISNAVPINEVAGEFLPDNLSQFHWKFGNTPPKGSKV

SEQ ID NO: 6436 - protein, 329 aa, Gossypium hirsutum
VSKLGFGCMGLTGVYNDPVPEEIGISIIKHAFHRGITFFDTSDFYGPKTNEILIGKALKQLPREKVQLATKFGIENMDSTGFIVNGTPQYVRTCIEASLKRLDVDYIDLYYQHRVDTNTPIEDTMSELKKLVEEGKIKYIGLSEASPETIKRAHAVHPITALQMEWSLWTRDIEDEIVPLCRELGIGIVPYSPLGSGFFAGRGVMETVPANSMLTYISRFQGENLDKNKKLYLKTEKLAKKHGCTSAQVALAWVLHQGDDVAPLPGTTKIKNLDSNIGSLKVKLTAEDLKEISDAVPINEVAGNPMPDILSRFSWKFSNTPPKGSKVST

SEQ ID NO: 6437 - protein, 322 aa, Gossypium hirsutum
CMGLTGVYNDSVHEEVGISIIKHAFHRGITFFDTSDFYGPKTNEILVGKALKQLPREKVQLATKFGIEKMDSAGVTINGTPEYVRACIEASLKRLDVDYIDLYYQHRVDTNTPIEDTMSELKKLVEEGKIKYIGLSGASPETIKRAHAVHPITALQIEWSLWTRDLEEEIVPLCRELGIGIVPYSPLGSGFFAGRGVLETMPANSFLPTFPRFQEENLDKNKIIYLKVEKLAKKHGCSPAQLALAWVLHQGDDVAPIPGTTKIKNLDSNSDSLKVELTEEDLKEISNAVPINEVAGEFLPDNLSQFHWKFGNTPPKGSKVST

SEQ ID NO: 6438 - protein, 294 aa, Theobroma cacao
MAEEQQRFQIPRVKLGNQGLEVSKLGFGCMGLSGAYNDPLPDDVGISIIKHAFDRGITFFDTSDIYGPKTNEVLVGKGLKQLPREKVQLATKFGFAKMEATGVTVNGTPEYVRASVEASLKRLDVEYIDLYYQHRVDTTTPIEDTMGELKKLVEEGKIKYIGLSEASPETITRAHAVHPITAVQMEWSLWTRDIEEEIVPLSRQLGIGIVPYSPLGHGFFGGRAVEESVPANSVLGILPRFQSENLERNKILYLKHGCTTAQLALAWVLHQGDDVVPIPGKEEKILIATLIHSG

SEQ ID NO: 6439 - protein, 215 aa, Gossypium hirsutum
MELKLEKKCTEELDDALSRAVLGHARMVEHYADLQEKYNDLVSKHRAIMEGIAEIKKAAAKAGSKGHGARFAKSLAAELSAIRVEREREKEQLKKENRSLRTQLRDTAEAVHAAGELLVRLREAEQAASIAEENFSNVQQENEKLKKQADKLKRKHKMEMVTMKQYLAESRLPESALQPLYREDSDVAASHNSSAIPYDDQAWRAEFGAIYQEHY

SEQ ID NO: 6440 - protein, 279 aa, Setaria italica
TEAGFTGIGVGAAYQGLRPIVEFMTFNFSMQAIDHIINSAAKSNYMSAGQISVPIVFRGPNGAAAGVGAQHSQCYAAWYAHVPGLKVLTPYSAEDARGLLKAAIRDPDPVIFLENELLYGESFPVSAEVLDSSFCLPIGKAKIEREGKDVTITTFSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAATA

SEQ ID NO: 6441 - protein, 229 aa, Zea mays
DTVPIVFRGPNGAAAGVGAQHSQCYAVWFAHVPGLKVLTPYSSEDARGLLKAAIRDPDPVIFLENELLYGESFPVSAEVLDSSFCLPIGKAKIERGGKDVTITAFSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAAAA

SEQ ID NO: 6442 - protein, 130 aa, Triticum aestivum
GYHCILQMVGYALQAADILAKEGISAEVINLRSIRPLDRAAINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 6443 - protein, 122 aa, Panicum virgatum
MVGYALQAADILAKEGISAEVINLRSIRPLDRAAINASVRKTNRLVTVEEGFPQHGIGAEICMAVVEDSFEYLDAPVERIAGADVPVPYAANLERMAVPQVEDIVRAAKRACYRAVPMAATA

SEQ ID NO: 6444 - protein, 243 aa, Leymus cinereus x Leymus triticoides
INSAAKSNYMSSGQISVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINTSVRKTNRLVTVEEGFPQHGVGAEICMSVVEDSFEYLDAPVERIAGADVPMPYAANLERLAVPQVEDIVRAAKRACYRSAPMAATA

SEQ ID NO: 6445 - protein, 138 aa, Unknown
  Sequence found in Organisms: Setaria italica, Momordica charantia
CLPIGKAKIERQGKDVTITAFSKMVGYALQAADILAKEGISAEVINLRSIRPLDRATINASVRKTNRLVTVEEGFPQHGIGAEICMSVVEDSFEYLDAPVERIAGADVPMSYAANLERMAVPQVDDIVRAAKRACYRV

SEQ ID NO: 6446 - protein, 238 aa, Persea americana
LGNYMSAGQISVPIVFRGPNGAAAGVGAQHSQCYAAWYASCPGLKVLTPYSSEDARGLLKAAIRDPDPVVFLENELLYGESFPVSAEALDSSFCLPIGKAKIEREGKHVTITAFSKMVGYALQAAEILAKEGISAEVINLRSIRPLDRDTINASVRKTNRLVTLEEGFPQHGVGAEICTSVIEESFEYLDAPVERIAGADVPMPYAANLERMAVPQVDDIVRAAKRACYRAVPVAAVA

SEQ ID NO: 6447 - protein, 224 aa, Pseudoroegneria spicata
VFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRSSSMAATA

SEQ ID NO: 6448 - protein, 267 aa, Triticum aestivum
GIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRSS

SEQ ID NO: 6449 - protein, 130 aa, Cenchrus ciliaris
  misc_feature (41)..(41): Xaa can be any naturally occurring amino acid
  misc_feature (46)..(46): Xaa can be any naturally occurring amino acid
  misc_feature (55)..(55): Xaa can be any naturally occurring amino acid
VTITTYSKMVGYALQAAEILSKEGISAEVINLRSIRPLDRXAINAXVRKTNRLVXVEEGFPQHGIGAEICMSVVEESFEYLDAPVERIAGADVPMPYAANLERMAVPQVDDIVRAAKRACYRAVPMAATA

SEQ ID NO: 6450 - protein, 131 aa, Olea europaea
DVTITAFSKMVGYALQAADILAKEGISAEVINLRSIRPLDRATINASVRKTNRLVTVEEGFPQHGVGAEICASVLEDSFEYLDAPVERIAGADVPMPYAANLERIAVPQVEDIVRAAKRSCYRSSSLAATA

SEQ ID NO: 6451 - protein, 132 aa, Cryptomeria japonica
KDVTITAFSKMVGYALQAAQELAKEGISAEVINLRSIRPLDRATINASVRKTNRLVTVEEGYPQHGIGAEICTSVVEESFEYLDAPVERIAGADVPMPYAANLERLAVPQVEDIIRAAKRACYREVPMSATA

SEQ ID NO: 6452 - protein, 168 aa, Amborella trichopoda
FLENELLYGESFPVSAEALDSSFTLPIGKAKIEREGKHVTITAFSKMVGYALKAADILSKEGISAEVINLRSIRPLDRNTINASVRKTNRLVTVEEGFPQHGVGAEICTSVIEESFEYLDAPVERIAGADVPMPYAANLERMAVPQIEDIVRAAKRACYRSVPMAAAA

SEQ ID NO: 6453 - protein, 215 aa, Eucalyptus grandis
  misc_feature (192)..(192): Xaa can be any naturally occurring amino acid
MLGVVRQKVSAGGSPLTILGQTLPFLRAAAAPLRSYSSAFKEMTVRDALNSALDEEMSADPRVFLMGEEVGEYQGAYKISKGLLDKYGPDRVLDTPITEAGFTGIGVGAAYHGLKPVIEFMTFNFSMQAIDHIINSAAKSNYMSSGQLSVPIVFRGPNGAAAGVGAQHSHCYASWYASCPGLKVLTPYSSEXARGLLKAAIRDPDPVVFLENELL

SEQ ID NO: 6454 - protein, 283 aa, Pseudoroegneria spicata
  misc_feature (3)..(3): Xaa can be any naturally occurring amino acid
DTXITEAGFTGIGVGAAYQGLRPVIEFMTFNFSMQAIDHIINSAAKSNYMSAGQINVPIVFRGPNGAAAGVGAQHSQCYAAWFAHVPGLKVLAPYSAEDARGLLKAAIRDPDPVVFLENELLYGESFPVSDEVLDSSFALPIGKAKIEREGKDVTITAFSKMVGYALQAADILSKEGISAEVINLRSIRPLDRAAINASVRKTNRLVTLEEGFPQHGVGAEICMSVVEESFEYLDAPIERIAGADVPMPYAANLERLAVPQIEDIVRAARRACYRALPMAATA

SEQ ID NO: 6455 - protein, 169 aa, Triticum aestivum
VFLENELLYGESFPIKAEVLDSSFSVPIGKAKIEREGKDVTITAFSKMVGYALQAAEILSKEGISAEVINLRSIRPLDRAAINASVRKTSRLVTVEEGFPQHGVGAEICMSVVEDSFEYLDAPVERIAGADVPMPYAANLERLAVPQVEDIVRAAKRACYRSSSMAANA

SEQ ID NO: 6456 - protein, 155 aa, Leymus cinereus x Leymus triticoides
MLGAARRQLGSGPMLGQVLRRLRPAAAASTEAARGYSSAAKEITVRDALNSALDEEMSADPSVFLMGEEVGEYQGAYKITKGLLDKYGPDRVLDTPITEAGFTGIGVGAAYQGLRPVIEFMTFNFSMQRTKWSCCWSWCSTLTVLCSLVCACSRT

SEQ ID NO: 6457 - protein, 187 aa, Rhizophora mangle
SEDARGLLKAAIRDPDPVVFLENELLYGESFPVSAEALDSSFCLPIGKAKIEREGKDVTIVAFSKMVGYVLKAAEILAKEGISAEVINLRSIRPLDRPTINTSVRKTNRLVTVEEAFPQHGVGAEICASVVEESFEYLDAPVERIAGADVPMPYAPNIERMAVPQVEDIVGAAKRACYRSVPMAATA

SEQ ID NO: 6458 - protein, 121 aa, Humulus lupulus
VGYVLQAAEILAKEGISAEVINLRSIRPLDRATINASVRKTNRLVTVEEGFPQHGVGAEICTSVIEESFGYLDAPVERIAGADVPMPYAANLERLAVPQIDDIVRAAKRACYRAVPLAATA

SEQ ID NO: 6459 - protein, 109 aa, Cenchrus ciliaris
KEGISAEVINLRSIRPLDRATINASVRKTNRLLTVEEGFPQHGIGAEICMSVVEDSFEYLDAPVERIAGADVPMPYAANLERMAVPQVDDIVRAAKRACYRVVPMAATA

SEQ ID NO: 6460 - protein, 186 aa, Cucurbita pepo
MLRGPFKGCHKGSQDPVGVSENELLYGESFPVSAEVLDSSFTAPIGKAKIEREGKDVTITAFSKMVGYALKAAEELSKEGISAEVINLRSIRPLDRATINASVRKTNRLVTVEEGFPQHGVGAEICASVVEDSFGYLDAPVERISGADIPMPYAANLERMAVPQIEDIVRAAKRACYRAVPLAATG

SEQ ID NO: 6461 - protein, 206 aa, Primula obconica
CYAAWYGSVPGLKVLAPYSAEDARGLLKAAIRDPDPVVFLENELLYGESFPVSQEVLDSSFCLPIGKAKIEREGKDVTIVAYSKMVGYALKAAEILAKEGINAEVINLRSIRPLDRSTINASVRKTNRLVTLEEAFPQHGVGAEICASVVEESFEYLDAPVERISGADVPMPYAANLERMAVPQIEDVVRAAKRACYRAVPMAATA

SEQ ID NO: 6462 - protein, 256 aa, Ocimum basilicum
MTFNFAMQAMDHLINSAAKTNYMSAGNISVPIVFRGPNGAAAGVGAQHSQCYAAWYGAIPGLKVLSPYSSEDARGLLKAAIRDPDPVIFLENEMLYGESFPISEEVLDSGFTIPIGKAKIEKEGKDVSIVAFSKMVGFSLKASDILAKEGIEAEVINLRSIRPLDRATINKSVRKTNRLVTVEEGFPQHGVGAEICTSIIEDSFEYLDAPVERIAGADVPMPYAANLERMALPQVEDIVRAAKRACYRSQSMQAVA

SEQ ID NO: 6463 - protein, 146 aa, Ocimum basilicum
SVFPIGKAKIEREGKDVTITAFSKMVGYALKAAEILAKDGISAEVINLRSIRPLDRATINASVRKTNRLVTLEEGFPQHGVGAEICASVVEDSFEYLDAAVERIAGADVPMPYAANLERAAVPQVEDIVRAAKRTCYRATALAATA

SEQ ID NO: 6464 - protein, 159 aa, Lotus japonicus
ESFPVSAEVLDSSFCLPIGKAKIEREGKDVTITAFSKMVGYALKAAEILAKEGISAEVINLRSIRPLDRSTINTSVRKTNRLVTVEEGFPQHGVGAEICTSVIEESFGYLDAPVERIAGADVPMPYAANLERMAVPQVEDIVRAAKRACYRSVPLAAAA

SEQ ID NO: 6465 - protein, 293 aa, Arachis hypogaea
LDKYGPERVLDTPITEAGFAGIGVGAAYYGLRPVVEFMTFNFSMQAIDHIINSAAKSNYMSAGQISVPIVFRGPNGAAAGVGAQHSQCYAAWYASCPGLKVLAPYSSEDARGLLKAAIRDPDPVVFLENELLYGESFPVSAEVLDSSFCLPIGKAKIEREGKDVTITAYSKMVGYALKAAEILAKEGVSAEVINLRSIRPLDRTTINASVRKTNRLVTVEEGFPQHGVGAEICTSVVEESFGYLDAPVERIAGADVPMPYAANLERMAVPQVEDIVRAAKRACHRSVPLAATA

SEQ ID NO: 6466 - protein, 147 aa, Secale cereale
GFALPIGKAKIEREGKDVTITAFSKMVGYALQAAEILSKEGISAEVINLRSIRPLDRAAINASVRKTNRLVTLEEGFPQHGVGAEICMSVVEESFEYLDAPIERIAGADVPMPYAANLERLAVPQIEDIVRAARRACYRALPMAANA

SEQ ID NO: 6467 - protein, 163 aa, Tamarix hispida
GLLYGESFPISPEVLDPNFSLPIGKAKIERQGKDLTITAFSKMVGYALQAADILAKEGISAEVINLRSIRPLDRPTINESVRKTNRLVTVEEGFPQHGVGAEICTSVIEDSFGYLDAPVERIAGADIPMPYAANFERMAVPQVEDIVRAAKRACYRSVPVAAA

SEQ ID NO: 6468 - protein, 106 aa, Curcuma longa
AADVLSAEGISAEVINLRSIRPLDRATINASVRKTNRLVTVEEGFPQHGVGAEICMSVVEESFEYLDAPVERIAGADVPMPYFANLERMAVPQVDDIVRAAKRACY

SEQ ID NO: 6469 - protein, 115 aa, Carica papaya
AAEILAKEGISAEVINLRSIRPLDRATINASVRKTNRLVTVEEGFPQHGVGAEICASVVEDSFGYLDAPVERIAGADVPMPYAANLERMAVPQIEDIVRAAKRACYRSMPMAAAA

SEQ ID NO: 6470 - protein, 239 aa, Castanea mollissima
AKSNYMSAGQISVPIVFRGPNGAAAGVGAQHSHCYASWYASCPGLKVLTPYSSEDARGLLKAAIRDPDPVVFLENELLYGESFPVSAEVLDSSFCLPIGKAKIEREGKDVTITAFSKMVGYALKAAEILAKEGISAEVINLRTIRPLDRSTINASVRKTNRLITVEEGFPQHGVGAEICTSVVEESFGYLDAPVERIAGADVPMPYAANLERLAVPQVEDIVRAAKRACYRSVPLAAAA

SEQ ID NO: 6471 - protein, 138 aa, Coffea canephora
KIEREGKDVTIVAFSKMVGYALKAAEILAKEGVSAEVINLRSIRPLDRATINTSVRKTNRLVTVEEGLPQHGVGAEICASIVEESFEYLDAPVERITGADVPMPYAANLERMAVPQVDDIVRAAKRTCYRSVPVAVNA

SEQ ID NO: 6472 - protein, 150 aa, Orobanche aegyptiaca
PVSAEVLDSSFCLPIGKAKIERSGKDVTITAFSKMVGYALQAAEILVKEGIDAEVINLRSIRPLDRSTINVSVRKTNRLVTVEEGFPQHGVGAEICTSVVEDSFEYLDAPVERIAGADVPMPYAANLERLAVPQVEDIVRAAKRTCYRSC

SEQ ID NO: 6473 - protein, 288 aa, Gossypium hirsutum
DLKGFLILQLLRLVYWNWVGAAYYGLKPVVEFMTFNFSMQAIDHIINSAAKSNYMSAGQISVPIVFRGPNGAAAGVGAQHSQCYAAWYASCPGLKVLSPYNSEDARGLLKAAIRDPDPVVFLENELLYGESFPVSDEVLDSSFCLPIGKAKIEREGKDVTITAFSKMVGYALKAAEMLEKDGIYAEVINLRSIRPLDRSTINASVRKTNRLITVEEGFPQHGVGAEICASVVEESFSYLDAPVERIAGADVPMPYAANLERMAVPQVEDIVRAAKRACYRSVPLAATA

SEQ ID NO: 6474 - protein, 222 aa, Fagopyrum esculentum
QRAQWCCCWSWCSTFPVLCSMVWFMSWVEGVGPILLRGCSGPSKSSYQRPRPCCFLENELLYGESFPVSAEALDSNFCLPIGKAKIERSGKDVTIIAFSKMVGYSLKAADILAKEGINAEVINLRTIRPLDRATINESIRKTNRLVTVEEGFPQHGVGAEICATVVEDSFEYLDAPVERISGADIPMPYAANLERLAVPQIEDIVRAAKRACYRSVPMAASA

SEQ ID NO: 6475 - protein, 145 aa, Parthenium argentatum
LPIGKAKIEREGKDVTITAFSKMVGYALKAAEILEKDGINAEVINLRSIRPLDRATINASVRKTNRLVTVEEGFPQHVIGAEICASVVEDSFGYLDAPVERIAGADVPTPYAANLERMAFPQIEDIVRAAKRTCYRSVPMAASAS

SEQ ID NO: 6476 - protein, 122 aa, Cajanus cajan
MVGYALKAAETLAKEGISAEVINLRSIRPLDRSTINNSVRKTNRLVTVEEGFPQHGVGAEICTSVIEESFGYLDAPVERIAGADVPMPYAANLERMAVPQVEDIVRAAKRACYRSVPLAAAA

SEQ ID NO: 6477 - protein, 334 aa, Helianthus annuus
MTVRDALNSALNEEMAADPNVFVMDEEVGEYQGAYKITKGLLDKYGPERVVDTPITEAGFAGIGVGSAYHGLRPVIEFMTFNFSMQAIDHVINSAAKSNYMSAGQINVPIVFRGPNGPAAGVGAQHSQCYGAWFGAVPGLKVLVPYSSEDARGLLKAAIRDPDPVVFLENELLYGESFPVSAEVLDSSFCLPIGKAKIEREGKDVTITAFSKMVGYALKAAEILEKDGINAEVVNLRSIRPLDRATINASVRKTNRLVTVEEGFPQHGIGAEICASVVEDSFGYLDAPVERIAGADVPTPYAANLERMAFPQIEDIVRAAKRACYRSPMAANAS

SEQ ID NO: 6478 - protein, 122 aa, Cichorium intybus
MVGYALKAAEILEKEGISAEVINLRSIRPLDRDTINASVRKTNRLVTVEEGFPQHGIGAEICASVVEDSFGYLDAPVERIAGADVPTPYAANLERSAFPQIEDIVRAAKRVCYRSVPMAATA

SEQ ID NO: 6479 - protein, 147 aa, Solanum melongena
EALDSSFSLPIGKAKIEREGKDVTITAFSKMVGYALKAAEILAKEGISAEVINLRSIRPLDRPAINASVRKTNRLVTVEEGFPQHGVGAEICASVVEESFEYLDAPIERIAGADVPMPYAANLERMAVPQIEDIVRAAKRTCYRSSN

SEQ ID NO: 6480 - protein, 115 aa, Lolium multiflorum
AAEILSKEGISAEVINLRSIRPLDRAAINASVRKTNRLVTVEEGFPQHGVGAEICMSVVEDSFEYLDAPVERIAGADVPTPYAANLERLAFPQVEDIVRAAKRACYRSSSMAATA

SEQ ID NO: 6481 - protein, 140 aa, Capsicum annuum
IEREGKDVTITAFSKMVGYALKAAEILAKEGISAEVINLRSIRPLDRPTINASVRKTNRLVTVEEGFPQHGVGAEICASVVEESFEYLDAPVERISGADVPMPYAANLERMAVPQIEDIVRAAKRACYRAAKSVPMAAAA

SEQ ID NO: 6482 - protein, 265 aa, Panicum virgatum
FGTEAKRPRLARSSSIASVCSVSSLDGDADADAGPSPAAPLPLLRTSSLPTETEEERWRRREMQSRRRLEARRKRVERRNSMGSSFLPSAPPRPAGEAPAAANGVQLRRSVGSQGSTSVPTTEQGIGGSAVCQSTDAKSPSTSDNTNENNMLPPPTKAAEKPQNGTSTEQPRLRTLGSLTTRTSSCSDIRKIMMEDMPMVSSKVEGPNARRIDGFLYRYKKGEDVRIVCVCHGSFLTPAEFVKHAGGGDVSNPLRHIVVNPSPFS

SEQ ID NO: 6483 - protein, 264 aa, Panicum virgatum
FGTEAKRPRLARSSSIASVCSVSSLDGDGDADADPSPAAPLPLLRTSSLPTETEEERWRRREMQSRRRLEARRKRVERRNSMGSSSLPSAPPKPAAEAPAAANGVQLRRSVGSQGSTSVTTTEQGIGGSAVCQSTDAKSPSTSDNTNQNNMLPPTKAVEKPQNGTSTEQPRLRTLGSLTMRTSSCSDIRKIMMEDMPMVSSKVEGPNARRIDGFLYRYKKGEDVRIVCVCHGSFLTPAEFVKHAGGGDVSNPLRHIVVNPSPFS

SEQ ID NO: 6484 - protein, 125 aa, Saccharum officinarum
  misc_feature (16)..(16): Xaa can be any naturally occurring amino acid
  misc_feature (30)..(30): Xaa can be any naturally occurring amino acid
EVLFRHPPVADAAVVXIPHPRWGETPFAFXVPRNNAAELSEDDVLAFCRKRMAGFMVPKKVEVVGALPRNALGKVEKVKLREAARKLAPTVPAQKPKGKTTTSSTTVGGRREEQPVAHVMAVSRL

SEQ ID NO: 6485 - protein, 618 aa, Theobroma cacao
MSCRLLSLNNLRIYIYVSFSCILDQQRKEKKEKERQKKKNQREIVRECAATVVEMRDIDDLPKNAANYMALTPLWFLERAATVHPARKAVVHASRTYTWLQTYRRCCCLASALSRRSVGVGSTVAIIAPNVPALYEAHFGIPMSGAVLNTVNIRLNASTIAFLLGHSQSAVVIVDQEFFTLAEDALKIMKEKSQGNFKHPLLIVIADESCDPKALRYALGKGAIEYEKFLESGDPEFAWKPPQDEWQSIALGYTSGTTASPKGVVLHHRGAYLMSLSNPLIWGMTEGAVYLWTLPMFHCNGWCFTWSLAALCGTNICLRQVTAKGVYSAIAKYGVTHFCGAPVVLNTIVNAPPKDTILPLPHVVHVMTAGAAPPPAVLSAMSQKGFRVTHTYGLSETYGPSTVCAWKPEWDSLPPETQARLNSRQGVRYIGLEGLDVISTKTGQPVPADGKTIGEIVIRGNVVMKGYLKNPKVNEETFANGWFHSGDLGVKHSDGYIEIKDRSKDIIISGGENISSVEVENNLYLHPAVLEASVVARVDERWGESPCAFVTLKPGVDKSDEQQLAEDIMRFCRSKMPAYWVPKSVVFGPLPKTATGKIQKHVLRAKAKELGPVKLSKL

SEQ ID NO: 6486 - protein, 337 aa, Brachypodium distachyon
MASLVPRLLRRRTLQPAQVLRSLRDSWMRLPDASSPRPAPLLHCSPGDAGCVLAARSWWFYSPVRYGSTAVTLNTDGGFARFSVGDSGTRQNGGQKQPPANKKKMSRKSKVNQLKWFRLKAKKKMKSPNPEVRIRYKLEKAKRKEEWLIEKLRKYEVPRVPEPVHDPEILTEEEKFYLKRTGEKKKNYVPVGRRGVFGGVVLNMHLHWKKHETMKVVCKPCRPGQVYEYAEELARLSKGTVIDIKPNNTIIFYRGKNYVQPKVMSPPDTLSKQKALEKYRYEQSLEHTSQFIEQLEKELEDYQKHVILFKNRDRAIPEKISNKDAIVDDLTTSSDTE

SEQ ID NO: 6487 - protein, 242 aa, Solanum phureja
MEPYYTLKMKRKDLEDVYDEFSEFSLSSPARKIRRLDADLPPIIEEVEEPEIPIAFEQAATYPSFGSNAVNRGLVIEELPSVPENEERAIVLFKPMNTQPVHSPSNFSVKVDPQFLNGLKSQIFWDNTANAFRLVDNEATQQDDSSSAKECLAVVPWVPSQFPSAAEAEVLSQPDVSDMMDAEDMEGVAMDIEDNSVDVEPRTAVEAGAVGVNDGFHHWQQQHCMTTTQLPQNTSTPIPWYR

SEQ ID NO: 6488 - protein, 242 aa, Solanum tuberosum
MEPYYTLKMKRKDLEDVYDEFSEFSLSSPARKIRRLDADLPPIIEEVEEPEIPIAFEQAATYPSFGSNAVNRGLVIEELPSVPENEERAIVLFKPMNTQPVHSPSNFSVKVDPQFLNGLKSQIFWDNTANAFRLVDNEATQQDDSSSAKECLAVVPWVPSQFPSAAEAEVFSQPDVSDMMDAEDMEGVAMDIEDNSVDVEPRTAVETGAVGVNDGLHHWQQQHCMTTTQLPQNTSTPIPWYR

SEQ ID NO: 6489 - protein, 76 aa, Solanum melongena
MKNTSKSSKISPKSSQDARKDRRSATGMSGSPKKGGHGGKFTWAGDGWTKKEDDAVVVVDAKDPNFDEPEENPIED

SEQ ID NO: 6490 - protein, 413 aa, Brachypodium distachyon
MPPAPPSRPSSTPSHRRPHPPTSNPVRRHHNLHLARCFPDQPQPAKPAPPNPNPLLSLLTAVPDWADAVTERRVRDPRPLYTHEQWREHRSSRRHLRHLLSSLSSRVILSLAPPVSAFTAVAAAVATYNTLVPAYALTASSLPYQLTAPALALLLVFRTEASYARFDEGRKAWIRVLAGAAELVGMVMHPAGGVAGDGTDEPAGRTALVNYILAFPVALKCHITSNSDIRKDLQGLLAEDDLNVVLTSKHRPRCIIEFISQSLQMLDFEEHRRSIMESKLSGFLEGICVCEQIIGIPVPLSYTRLTSRFLVLWHLTLPVILWSECKWIVVPATFISAASLFCIEEVGVLIEEPFPMLALDEQCKQLHDSMHDMMSVQDSVRKRLVAKTKSQQRSGRYPNNGRPGSKSEQVKID

SEQ ID NO: 6491 - protein, 152 aa, Triticum aestivum
  misc_feature (79)..(79): Xaa can be any naturally occurring amino acid
MQAAKEKVKDGVSAVKAKAKITQAKASEKAEAATARSHAERELAHERGKAKVAAAKMELHQDKALHREEAMEHRIHKHXRRPRPPPPQARRRHRGRAPAGDRCRGLPPSSRRRWPLLLISYAAGSPARWAHASRLCDVFSIANKSVLCAVYV

SEQ ID NO: 6492 - protein, 117 aa, Triticum aestivum
MQAAKEKVKDGVSAVKAKAKITQAKASEKAEAATARSHAERELAHERGKAKVAAAKMELHQDKALHREEAMEHRIHKHRGGHGRHHHKHGVGIVAAPPPATGAGAYHPPPAAGGHYY

SEQ ID NO: 6493 - protein, 119 aa, Triticum aestivum
MQAAKEKVKDGVSAVKAKTKITQAKASEKAEAATARSHAERELAHERGKAKVAAAKMELHQDKALHREEAMEHRIHKHGGGHGRHQHKHGVGIVAAPPPATGAGAGAYHPPPAAGGHYY

SEQ ID NO: 6494 - protein, 118 aa, Triticum aestivum
MQAAKEKVKDGVSAVKAKTKITQAKASEKAEAATARSHAERELAHERGKAKVAAAKMELHQDKALHREEAMEHRIHKHGGHGRHHHKHGVGIVAAPPPATGAGAGAYHHPPAAGGHYY

SEQ ID NO: 6495 - protein, 115 aa, Triticum aestivum
  misc_feature (82)..(82): Xaa can be any naturally occurring amino acid
MQAAKEKVKDGVSAVKAKTKITQAKASEKAEAATARSHAERELAHERGKAKVAAAKMELHQDKALHREEAMEHRIHKHGGGXGRHHHKHGVGFVAAPPPVAGAYHPPPAAGGHYY

SEQ ID NO: 6496 - protein, 352 aa, Lactuca sativa
MADLNGGAQYTDFPAVPTHGGQFVRYNIFSNEFEVTAKYVPPIMPIGRGAYGIVCSMLNSETNEMVGMKKIMNAFDNYMDAKRTLREIKLLRHLDHENVIALKDVVPPPVYTEFSDVYIATELMDTDLHQIIRSNQNLSEEHCQYFLYQLLRGLKYIHSAKVIHRDLKPSNLLLNANCDLKICDFGLARPNADNDFMTEYVVTRWYRAPELLLNSSDYSAAIDVWSVGCIYMELMNRKPLFPGKDHVHQMRLLTELLGTPSESDLGFIKNEDAKRYIAQLPRHPRKSLLNTFPHVHPSAIDLVERMLTFDPTKRITVEEALEHPYLERLHDVEDEPICPNPFSFDFEQQVLG

SEQ ID NO: 6497 - protein, 373 aa, Centaurea maculosa
  misc_feature (51)..(51): Xaa can be any naturally occurring amino acid
MADASGGGPHYTDFPAVATHGGQFIRYNIFDNEFEITAKYRPPIMPIGRGXYGIVCSMLNSETNEMVAVKKIANAFDNYMDAKRTLREIKLLRHLDHENVIAIKDIIPPPLRREFSDVYITTELMDTDLHQIIRSNQNLSEEHCQYFLYQLLRGLKYIHSANVIHRDLKPSNLLLNANCDLKICDFGLARTNAENDFMTEYVVTRWYRAPELLLNSSDYTAAIDVWSVGCIFMELMNKKPLFAGKDHVHQMRLLTELLGTPTESDLRFIRNEDAKRYLAQLPQHPRQSLAKTFPHVHPLAIDLVDKMLTMDPTKRITVEDALDHPYLARLHDVADEPICMDPFSFEFEQQVLGEEQIKDLIYQEALAHNPGFA

SEQ ID NO: 6498 - protein, 371 aa, Artemisia annua
MADSGGGQYTDFPAVPTYGGQFIRYNIFGNDFEITNKYRPPIMPIGRGAYGIVCSMLNAETNEMVAVKKIANAFDNYMDAKRTLREIKLLRHLDHENIIAIKDIIPPPLRREFSDVYITTELMDTDLHQIIRSNQNLSEEHCQYFLYQLLRGLKYIHSANVIHRDLKPSNLLLNANCDLKICDFGLARTSAENDFMTEYVVTRWYRAPELLLNSSDYTAAIDVWSVGCIYMELMNKKPLFPGKDTVHQMRILTELLGTPTESDLRFIRNEDARRYLAQLPQHPRQSLSTVFPHVHPLAIDLVDKMLTMDPTKRITVEDALDHPYLARLHDVADEPICAEPFSFQFEQQVLGEEQIKDLIYEEALAHNPGFA

SEQ ID NO: 6499 - protein, 369 aa, Helianthus annuus
MADNSGGHDFPAVATHGGQFIRYNIFGNEFEITNKYRPPIMPIGRGAYGIVCSMLNAETNEMVAVKKIANAFDNYMDAKRTLREIKLLRHLDHENIISIKDIIPPPVRREFTDVYITTELMDTDLHQIIRSNQNLSEEHCQYFLYQLLRGLKYIHSANVIHRDLKPSNLLLNANCDLKICDFGLARTSAENDFMTEYVVTRWYRAPELLLNSSDYTAAIDVWSVGCIFMELMNKKPLFPGKDHVHQMRILTELLGTPTESDLRFIRNEDARRYLAQLPQHPRQSLSTVFPHVHPLAIDLVDKMLTLDPTRRITVEDALDHPYLARLHDVADEPICADPFSFEFEQQVLREEQIKDLIYEEALAHNPGFA

SEQ ID NO: 6500 - protein, 372 aa, Vinca minor
MADVNMTGGFPEFPAVATHGGQFIRYDIFGNLFEITPKYRTPIMPIGRGAYGIVCSVMNVETNEMVAIKKIANAFDNFMDAKRTLREIKLLRHLDHENVIAIRDVIPPPLRREFSDVYIATELMDTDLHQIIRSNQNLSEEHCQYFLYQLLRGLKYIHSANVIHRDLKPSNLLLNANCDLKICDFGLARPNTENEFMTEYVVTRWYRAPELLLNSSDYTAAIDVWSVGCIFLELMNRKPLFPGKDHVHQMRLLTQLLGTPTESDLGFVRNEDAKRYIRQLPQFPRQQLTSVFPHVNPLAIDLIDKMLTFDPAKRITVEEALAHPYLERLHDIADEPVCTKPFSFDFEQQGIGEEQIKDMIYQEASTLNPEYA

SEQ ID NO: 6501 - protein, 333 aa, Euphorbia peplus
MANGGPGGQYGDFPAVPSHGGLFVQYNIFGNQFEVTSKYRPPIMPIGRGAYGIVCSVLNSETNEMVAVKKIANAFDNQMDAKRTLREIKLLRHLDHENVVALRDVIPPPLRREFTDVYIATELMDTDLHQIIRSNQGLSEEHCQYFLYQILRGLKYIHSANVIHRDLKPSNLLLNANCDLKVCDFGLARPTSENEFMTEYVVTRWYRAPELLLNSSEYTAAIDVWSVGCIYMELMNRKPLFPGKDHVHQMRLLTELLGTPTESDLGFVKNEDAKRYIRQLSPCPRQPLAQVFPHVNPLAVDLIDKMLTFDPTKRITVEEALEHPYLARFTRRS

SEQ ID NO: 6502 - protein, 368 aa, Primula obconica
MADVNQYPEFPAVVTHGGQFVQYNIFGNLFEVTPKYRPPIMPIGRGAYGIVCSVLNAETNEMVAMKKIANAFDNYMDAKRTLREIKLLRHLDHENVISLRDVVPPPLRREFSDVYIATELMDTDLHQIIRSNQNLSEEHSQYFLYQLLRGLKYIHSANVIHRDLKPSNLLLNSNCDLKICDFGLARPTSENEFMTEYVVTRWYRAPELLLNSADYTAAIDIWSVGCVYMELMNRKPLFAGRDHVHQLRLLTELLGTPTEADLGFVRSDDAKRYIRQLPQFPRQSLAKLFPHVHPLAIDLVDKMLTFDPSRRITVEEALAHPYLERLHDVADEPICTHPFSFDFEQALGEEQIKDMIYQEALLLNPEYA

SEQ ID NO: 6503 - protein, 375 aa, Gossypium hirsutum
MADVAPGNAGGQFGDFPTIHTHGGQFIQYNIFGNLFEVTSKYRPPIMPIGRGAYGIVCSVLNSETNEMVAVKKIANAFDNHMDAKRTLREIKLLRHLDHENVIGIKDVIPPPLRREFTDVYIATELMDTDLHQIIRSNQSLSEEHCQYFLYQILRGLKYIHSANVIHRDLKPSNLLLNANCDLKICDFGLARPTAENEFMTEYVVTRWYRAPEILLNSSDYTAAIDVWSVGCIFMELMNRKPLFPGKDHVHQMRLLTELLGTPTESDLGFLRNEDARRYIRQLPAHPRQSLAEVFPHVHPLAIDLIDRMLTFDPTRRITVEEALAHPYLERLHDISDEPVCPEPFSFDFEQQPLGEEQMKDMIYQEALALNPTYA

SEQ ID NO: 6504 - protein, 371 aa, Fragaria vesca
MADHLPSGNGDFPAVPSHGGQYIQYNIFGNLFEITNKYRPPIMPIGRGAYGIVCSVLNSETNEMVAIKKIANAFDNHMDAKRTLREIKLLRHLDHENVVAIRDVIPPPVRREFSDVYIAAELMDTDLHQIIRSNQGLSEEHCQYFLYQILRGLKYIHSANVIHRDLKPSNLLLNANCDLKICDFGLARPTAENELLTEYVVTRWYRAPELLLNSSDYTAAIDVWSVGCIFMELMNRKPLFPGKDHVNQMRLLTELLGTPTESDLGFVRNEDARRYIRQLPQFPRQQMVKLFPHVHPLAIDLVDRMLTFDPTKRITVEEALAHPYLERLHDVADEPICTVPFSFDFEQQSLGEEQMKDMIYREAIAFNPEYA

SEQ ID NO: 6505 - protein, 372 aa, Catharanthus roseus
MADVNMAGGFPDFPVLATHGGQFVQYDIFGNLFEITTKYRPPIMPIGRGAYGIVCSVLNVETNEMVAIKKIANAFDNFMDAKRTLREIKLLRHLDHENIIAIRDVIPPPLRREFSDVYIATELMDTDLHQIIRSNQNLSEEHCQYFLYQILRGLKYIHSANVIHRDLKPSNLLLNANCDLKICDFGLARPNTENEFMTEYVVTRWYRAPELLLNSSDYTAAIDVWSVGCIFMELMNRKTLFPGRDHVHQMRLLTELLGTPTESDLGFVRNEDAKRYIRQLPRFPRQQLASVFSHINPLAIDLIDKMLTFDPAKRITVDEALAHPYLARLHDTADEPVCSEPFSFDFEQQAFGEEQIKDMIYQEALALNPEYA

SEQ ID NO: 6506 - protein, 370 aa, Prunus persica
MADVPPSSGDFPAVPSHGGQYIQYNIFGNLFEITNKYRPPIMPIGRGAYGIVCSVLNSETKEMVAMKKIANAFDNHMDAKRTLREIKLLRHLDHENVVAIRDVIPPPLRREFSDVYIATELMDTDLHQIIRSNQGLSEEHCQYFLYQILRGLKYIHSANVIHRDMKPSNLLLNANCDLKICDFGLARPTAENELLTEYVVTRWYRAPELLLNSSDYTAAIDVWSVGCIFMELMNRKPLFPGKDHVHQMRLLTELLGTPTESDLGFVRNEDARRYIRQLPPHPRQPLARLFPHVNPLAIDLIDRMLTFDPTKRITVEEALAHPYLERLHDVADEPICNEPFSFDFEQQPLGEEQMKDMIYREAIALNPEYA

SEQ ID NO: 6507 - protein, 346 aa, Cynara scolymus
  misc_feature (183)..(183): Xaa can be any naturally occurring amino acid
  misc_feature (192)..(193): Xaa can be any naturally occurring amino acid
MADLNGGAQYTDFPAMPTYGGRFVRYNIFGNEFEITSKYLPPIMPIGRGAYGIVCSMLNSETNEMVAMKKIMNAFDNYMDAKRTLRGIKLLRHLDHENVVAIKDVVPPPLQREFSDVYIATELMDTDLHQIIRSNQIFRRHCQYFLYQLLRGLKYIHSAKVIHRDLKPSNLLLNANCDLKICXFGLARPNAXXDFMTEYVVTRWYRAPELLLNSSDYSAAIDVWSVGCIYMELMNRKPLFAGKDHVHQMRLLTELLGTPCESELGFIKNEDARRYIAQLPRHPRKSLLKTFPHVNPSAIDLVEKMLTFDPARRITVEEALEHPYLERLHDIDDEPVCANPFSFDFE

SEQ ID NO: 6508 - protein, 369 aa, Castanea mollissima
MAGTGQYGEFPAVPTHGNQFIQYNIFGNLFEVTAKYRPPIMPIGRGAYGIVCSVLNSETNELVAMKKIANAFDNHMDAKRTLREIKLLRHFDHENVVALKDVVPPPLRREFTDVYIATELMDTDLHQIIRSNQSLSEEHCQYFLYQILRGLKFIHSANVIHRDLKPSNLLLNANCDLKICDFGLARPTAENEFMTEYVVTRWYRAPELLLNSSDYTAAIDVWSVGCIFMELMNRKPLFPGKDHVHQMRLLIELLGTPTESDLGFVRNEDARRYIRQLPSHPRQPLAAVFSHVHPLAIDLIEKMFTFDPTKRITVEEALAHPYLARLHDIADEPVCPKPFSFDFEQQPLGEEQMKDMIYQEALSLNPEYA

SEQ ID NO: 6509 - protein, 373 aa, Eucalyptus grandis
MADAAAQNGQFSDFPAVPTHGGQFIQYNIFGNHFEITAKYRPPIMPIGRGAYGIVCSVLNSETNEMVAIKKIANAFDNHMDAKRTLREIKLLRHLDHENVIGIRDVIPPPLRREFTDVYIAMELMDTDLHQIIRSNQGLSEEHCQYFLYQILRGLKYIHSANVIHRDLKPSNLLLNANCDLKIIDFGLARPTAENEFMTEYVVTRWYRAPELLLNSSDYTAAIDVWSVGCIFMELMNRKPLFPGRDHVHQMRLLVELLGTPADADLGFVRNEDARRYIRQLPQHPRQPLASVFPHVHPLAIDLVEKMLTFDPTKRITVEEALAHPYLTRLHDIADEPVCRQPFSFEFEQQPLGEEQMKDMIYQEAIALNPEFA

SEQ ID NO: 6510 - protein, 372 aa, Tropaeolum majus
MVDGNGSSQFSDFPMVATHGGQYIQYNIFGNMFEITSKYRPPIMPIGRGAYGIVCSVLNTETNEMVAIKKIANAFDNHMDAKRTLREIKLLRHLDHENVIAIRDVIPPPLRREFVDVYMTTELMDTDLHQIVRSNQGLSEEHCQYFLYQILRGLKYIHSANVIHRDLKPSNLLLNANCDLKICDFGLARPTSENEFMTEYVVTRWYRAPELLLNSSDYTAAIDVWSVGCIYMELMNRKPLFPGNDHVHQMRLLTELLGTPTESDLGFTRNEDAKRYIRQLPVHPRQSLERVFPHVHPLAIDLVDKMLTFDPTRRITVEEALAHPYLARLHDIADEPVCLEPFSFDFEQQPLGEEQMKDMIHREALALNPGYA

SEQ ID NO: 6511 - protein, 375 aa, Theobroma cacao
MAEVVPENAGGQLGDFPAIHTHGGQYIQYSIFGNLFQITSKYRPPIMPIGRGAYGIVCSVLNSETNEMVAVKKIANAFDNHMDAKRTLREIKLLRHLDHENVIAIRDVIPPPLRREFTDVYIATELMDTDLHQIIRSNQGLSEEHCQYFLYQILRGLKYIHSANVIHRDLKPSNLLLNANCDLNICDFGLARPAAENEFMTEYVVTRWYRAPELLLNSSDYTAAIDVWSVGCIFMELMNRKPLFPGKDHVHQMRLLTELLGTPTESDLGFLRNEDARRYLRQLPAHPRQPLANVFPHVHPLAIDLIERMLTFDPTRRITVEEALAHPYLERLHDIADEPVSAEPFSFDFEQQPLGEEQMKDMIYKEAIALNPNYA

SEQ ID NO: 6512 - protein, 375 aa, Vitis vinifera
MADNTRNSTGGQLSDFPAVPTHGGLFFQHNIFGNLFEITAKYRPPIMPIGRGAYGIVCSVLNSETNEMVAIKKIANAFDNHMDAKRTLREIKLLRHLDHENVIGIRDVVPPPLRREFSDVYIATELMDTDLHQIIRSNQGLSEEHCQYFLYQILRGLKYIHSANVIHRDLKPSNLLLNANCDLKICDFGLARPTAENEFMTEYVVTRWYRAPELLLNSSDYTAAIDVWSVGCIFMELMNRRPLFAGKDHVHQMRLLTELLGTPTESDLGFVRNDDARRYIMQLPQHPRQPLVNVFPHIHPLAIDLIDRMLTFDPTKRITVEEALAHPYLSRLHDTADEPVCPEPFSFEFEQQALVEEQMKDMIYQEALFFNPGYA

SEQ ID NO: 6513 - protein, 370 aa, Malus domestica
MADLTPSNGDFPAVPSHGGQYIQYNIFGNLFEITNKYRPPIMPIGRGAYGIVCSVLNSETKEMVAIKKIANAFDNHMDAKRTLREIKLLRHLDHENVIAIRDVIPPPLRREFSDVYIATELMDTDLHQIIRSNQGLSEEHCQYFMYQILRGLKYIHSANVIHRDLKPSNLLLNANCDLKICDFGLARPTAENELLTEYVVTRWYRAPELLLNSSDYTAAIDVWSVGCIFMELMNRKPLFPGKDHVHQMRLLTELLGTPTESDLGFVRNEDARRYIRQLAQHPRQPLERLFPHVNPMAIDLVDRMLTFDPTRRITVEQALAHPYLERLHDVADEPICTEPFSFDFEQQPLGEEQMKDMIYREAIALNPEYA

SEQ ID NO: 6514 - protein, 370 aa, Brassica napus
MNNAGGQYPDFPAVQTHGGQFISYDIFGSLFEVTSKYRPPIVPIGRGAYGIVCSVLDSETNELVAMKKIANAFDNHMDAKRTLREIKLLRHLDHENIIAIRDVVPPPLRREFSDVYIATELMDTDLHQIIRSNQGLSEEHCQYFLYQLLRGLKYIHSAKVIHRDLKPSNLLLNANCDLKICDFGLARPTSENEFMTEYVVTRWYRAPELLLNSSDYTAAIDVWSVGCIFMELMNRKPLFPGKDHVHQMRLLTELLGTPTESDLGFTHNEDAKRYIRQLPNFPRQPLAKLFSHVNPLAIDLVDRMLTFDPNKRITVEEALNHPYLAKLHDPNDEPICLKPFSFDFEQQPLDEEQIKEMIYREAIALNPTYA

SEQ ID NO: 6515 - protein, 380 aa, Humulus lupulus
MVDATHNNGPGAGPGGQYTDFPAIPSHGGQYIQYNIFGNLFEITSKYRPPIMPIGRGAYGIVCSVLNSETNEMVAMKKIANAFDNHMDAKRTLREIKLLRHLDHENIVAIRDVIPPPLRREFTDVYIATELMDTDLHQIIRSNQGLSEEHCQYFLYQILRGLKYIHSANVIHRDLKPSNLLLNANCDLKICDFGLARPTAENEYMTEYVVTRWYRAPELLLNSSDYTASIDVWSVGCIFMELMNRKPLFPGKDHVHQMRLLTELLGTPTESDLGFIRNEDAKRYIRQLPSFPRQQLGRAFPHVHTLAIDLIEKMLTFDPNRRITVEEALAHPYLTRLHDVADEPVCPNPFSFEFEQQPLTEEQMKDMIYQEAIALNPQYA

SEQ ID NO: 6516 - protein, 370 aa, Brassica rapa
MNNAGGQYPDFPAVQTHGGQFISYDIFGSLFEVTSKYRPPIVPIGRGAYGIVCSVLDSETNELVAMKKIANAFDNHMDAKRTLREIKLLRHLDHENIIAIRDVVPPPLRRQFSDVYIATELMDTDLHQIIRSNQGLSEEHCQYFLYQLLRGLKYIHSAKVIHRDLKPSNLLLNANCDLKICDFGLARPTSENEFMTEYVVTRWYRAPELLLNSSDYTAAIDVWSVGCIFMELMNRKPLFPGKDHVHQMRLLTELLGTPTESDLGFTHNEDAKRYIRQLPNFPRQPLAKLFSHVNPLAIDLVDRMLTFDPSKRITVEEALNHPYLAKLHDPNDEPICLKPFSFDFEQQPLDEEQIKEMIYREAIALNPTYA

SEQ ID NO: 6517 - protein, 367 aa, Actinidia deliciosa
  misc_feature (117)..(117): Xaa can be any naturally occurring amino acid
  misc_feature (129)..(129): Xaa can be any naturally occurring amino acid
MADVNSADFPAVAVHGGQFIQYNIFGNLFEITTKYRAPIMPIGRGAYGIVCSVMNSETNEMVAIKKIANAFDNYMDAKRTLREIKLLRHLDHENVITIKDVVPPPLRREFSDVYIAXELMDTDLHQIIXSNQGLSEEHCQYFLYQILRGLKYIHSANVIHRDLKPSNLLLNANCDLKICDFGLARPTSENEFMTEYVVTRWYRAPELLLNSSEYTAAIDVWSVGCIFMELMNRKPLFPGKDHVHQMRLLTELLGTPTESDLGFVRSEDARRYIRQLPRHPRQQLTRVFSHVHPLAIDLVDKMLTFDPTRRITVEEALAHPYLARLHDIADEPVCPESFSFDFEQAMGEEQIKDMIYQEALSLNPEYA

SEQ ID NO: 6518 - protein, 370 aa, Raphanus sativus
MNNAGGQYPEFPAVQTHGGQFISYDIFGSLFEITSKYRPPIVPIGRGAYGIVCSVLDSETNELVAMKKIANAFDNHMDAKRTLREIKLLRHLDHENIIAIRDVVPPPLRRQFSDVYIATELMDTDLHQIIRSNQGLSEEHCQYFLYQLLRGLKYIHSAKVIHRDLKPSNLLLNANCDLKICDFGLARPTSENEFMTEYVVTRWYRAPELLLNSSDYTAAIDVWSVGCIFMELMNRKPLFPGKDHVHQMRLLTELLGTPTESDLGFTHNEDAKRYIRQLPTFPRQPLAKLFSHVNPLAIDLVDRMLTFDPNKRITVEEALNHPYLAKLHDPNDEPICLKPFSFDFEQQPLDEEQIKEMIYREAIALNPTYA

SEQ ID NO: 6519 - protein, 375 aa, Unknown
  Sequence found in Organisms: Citrus sinensis, Citrus clementina
MADVAQVNGVGQTADFPAVPTHGGQFIQYNIFGNLFEITAKYRPPIMPIGRGAYGIVCSVLNTETNELVAMKKIANAFDNHMDAKRTLREIKLLQHLDHENVIAVKDVVPPPLRREFTDVYIAAELMDTDLYQIIRSNQSLSEEHCQYFLYQLLRGLKYIHSANVIHRDLKPSNLLLNANCDLKICDFGLARPTSENEFMTEYVVTRWYRAPELLLNSSDYTAAIDVWSVGCIFMELMNRRPLFPGNDHVHQMRLLIELLGTPTDADLGFVRNEDAKRYIRQLPQHPRQSLAQVFPHVHPLAIDLVDRMLTFDPMKRITVDEALAHPYLARLHDEADEPVCPEPFSFDFEQQSLGEEQIKDMIYQEALALNPGFA

SEQ ID NO: 6520 - protein, 376 aa, Quercus alba
MADINQNVAATGQYGEFPAVQTHGGQFLQYNIFGNLFEVTAKYRPPIMPIGRGAYGIVCSVMNSETNEMVAMKKIANAFDNHMDAKRTLREIKLLRHFDHENVVALRDVVPPPLRREFTDVYIATELMDTDLHQIIRSNQSLSEEHCQYFLYQILRGLKFIHSANVIHRDLKPSNLLLNANCDLKICDFGLARPTAENEFMTEYVVTRWYRAPELLLNSSDYTAAIDVWSVGCIFMELMTRKPLFPGKDHVNQMRLLIELLGTPSESDLGFVRNEDARRYIRQLPSHPRQPLAAVFSHVHPLAIDLIEKMFTFDPTKRITVEEALAHPYLARLHDIADEPVCPKPFSFEFEQQPLGEEQMKDMIYQEALSLNPEYA

SEQ ID NO: 6521 - protein, 371 aa, Populus trichocarpa
MANYAQGNGDFPAIPTHGGQFIQYNIFGNLFEITSKYRPPITPIGRGAYGIVCSVLNSETNEMVAVKKIANAFDNQMDAKRTLREIKLLRHLDHENVIGIRDVIPPPLRREFTDVYIAMELMDTDLHQIIRSNQGLSEEHCQYFLYQILRGLKYIHSANIIHRDLKPSNLLLNANCDLKICDFGLARPTSENEFMTEYVVTRWYRAPELLLNSSDYTAAIDVWSVGCIFMELMNRKPLFPGKDHVHQMRLLTELLGKPTESDLGFVRNEDARRYIQQLDSHPRRSLAELFPLVHPLAIDLIDKMLTFDPTKRITVEEALAHPYLARLHDIADEPVCLEPFSFEFEQQPLAEEQMKDMIYEEALALNPEYAC

SEQ ID NO: 6522 - protein, 370 aa, Carica papaya
MVDANSGGQDFPAIPTHGGQYIQYNIFGNLFEITSKYRPPIMPIGRGAYGIVCSVYNSETNEMVAIKKIANAFDNHMDTKRTLREIKLLRHLDHENVVGIRDVIPPPLRREFTDVYIATELMDTDLHNIIRSNQGLSEEHCQYFLYQILRGLKYIHSANVIHRDLKPSNLLVNANCDLKICDFGLARPTAENEFMTEYVVTRWYRAPEILLNSSDYTAAIDVWSVGCIFMELMNRKPLFPGRDHVHQLRLLTELLGTPTESDLEFVRNEDAKRYIRQLPTHPRQPLARHFPNVHPSAIDLVDRMLTFDPRKRITVEEALAHPYLARLHDIADEPVCSEPFSFDFEQQPLGEEQMKDMIYQEALALNPEYA

SEQ ID NO: 6523 - protein, 375 aa, Nicotiana tabacum
MADANMGAGGGQFPDFPSVLTHGGQYVQYDIFGNFFEITTKYRPPIMPIGRGAYGIVCSVLNTELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTEADLGFLQNEDAKRYIRQLPQHPRQQLAEVFPHVNPLAIDLVDKMLTFDPTRRITVEEALDHPYLAKLHDAGDEPICPVPFSFDFEQQGIGEEQIKDMIYQEALSLNPEYA

SEQ ID NO: 6524 - protein, 370 aa, Cucumis sativus
MADVGQNNPADFPALPTHGGQYVQYNIFGNPFEITSKYRPPIMPIGRGAYGIVCSVLNSETNEMVAVKKIANAFDNHMDAKRTLREIKLLRHLDHENVIGIRDVIPPPLRREFNDVYISTELMDTDLHQIIRSNQSLSEEHCQYFLYQILRGLKYIHSANVIHRDLKPSNLLLNANCDLKICDFGLARPTSENECMTEYVVTRWYRAPELLLNSDYTAAIDIWSVGCIFLELMNRRPLFPGRDHVHQMRLLTELLGTPSESDLGFIRNEDSKRYLRQLPPHPRQPLATVFPHVHPLAIDLVDKMLTFDPTKRITVEEALAHPYLERLHDIADEPVCSEPFSFEFEQQYLDEEQMKEMIYREALALNPEFA

SEQ ID NO: 6525 - protein, 250 aa, Quercus alba
MADINQNVAATGQYGEFPAVQTHGGQFLQYNIFGNLFEVTAKYRPPIMPIGRGAYGIVCSVMNSETNEMVAMKKIANAFDNHMDAKRTLREIKLLRHFDHENVVALRDVVPPPLRREFTDVYIATELMDTDLHQIIRSSQSLSEEHCQYFLYQILRGLKFIHSANVIHRDLKPSNLLLNANCDLKICDFGLARPTAENEFMTEYVVTRWYRAPELLLNSSDYTAAIDVWSVGCIFMELMTRKPLFPGRIT

SEQ ID NO: 6526 - protein, 375 aa, Juglans hindsii x Juglans regia
MADANHSSAAGQLGDFPAVPTHGGQFFQHNIFGNLFEITAKYRPPIMPIGRGAYGIVCSVLNSETNEMVAMKKIANAFDNHMDAKRTLREIKLLRHFDHENIIGIRDVVPPPLRREFTDVYIAMELMDTDLHQIIRSNQSLSEEHCQYFLYQLLRGLKFIHSANVIHRDLKPSNLLLNANCDLKICDFGLARPTAENEFMTEYVVTRWYRAPELLLNYSDYTAAIDVWSVGCIFLELMNRKPLFPGRDQAHQMRLLIELLGTPTESDFWFVRNEDTKRYIRQLPRHPRQPLAIVFPHVNPLAIDLMEKMLTFDPAKRITVEEALAHPYFERLHDVADEPVCSEPFSFDFEQKPLEEEQMKDMIYQEALAFNPEHA

SEQ ID NO: 6527 - protein, 370 aa, Cucumis melo
MADVGQNNPADFPALPTHGGQYVQYNIFGNPFEITSKYRPPIMPIGRGAYGIVCSVLNSETNEMVAVKKIANAFDNHMDAKRTLREIKLLRHLDHENVIGIRDVIPPPLRREFNDVYISTELMDTDLHQIIRSNQSLSEEHCQYFLYQILRGLKYIHSANVIHRDLKPSNLLLNANCDLKICDFGLARPTSENECMTEYVVTRWYRAPELLLNSDYTAAIDIWSVGCIFLELMNRRPLFPGRDHVHQMRLLTELLGTPTESDLGFIRNEDSKRYLRQLPPHPRQPLATVFPHVHPLAIDLVDKMLTFDPTKRITVEEALAHPYLERLHDTADEPVCSEPFSFEFEQQYLDEEQMKEMIYREALALNPEFA

SEQ ID NO: 6528 - protein, 371 aa, Glycine max
MAGVNPNGVADFPATPTHGGQFIQYNIFGNLFEVTAKYRPPIMPVGRGAYGIVCSLLNTETNELVAVKKIANAFDNHMDAKRTLREIKLLRHLDHENVIGLRDVIPPPLRREFNDVYIATELMDTDLHHIIRSNQNLSEEHSQYFLYQILRGLKYIHSANVIHRDLKPSNLLLNSNCDLKIIDFGLARPTLESDFMTEYVVTRWYRAPELLLNSSDYTSAIDVWSVGCIFMELMNKKPLFPGKDHVHQMRLLTELLGTPTEADLGLVKNEDARRYIRQLPQYPRQPLAQVFPHVHPAAIDLVDKMLTVDPTKRITVEEALAHPYLEKLHDVADEPICMEPFSFDFEQQQLDEEQIKEMIYREALALNPEYA

SEQ ID NO: 6529 - protein, 371 aa, Glycine max
MAGVNPNGVADFAAVPTHGGQFIQYNIFGNLFEVTTKYRPPIMPIGRGAYGIVCSLLNTETNELVAVKKIANAFDNHMDAKRTLREIKLLRHLDHENVIGLRDVIPPPLRREFNDVYIATELMDTDLHHIIRSNQNLSEEHCQYFLYQILRGLKYIHSANVIHRDLKPSNLLLNSNCDLKIIDFGLARPTLESDFMTEYVVTRWYRAPELLLNSSDYTSAIDVWSVGCIFMELMNKKPLFPGKDHVHQMRLLTELLGTPTEADLGLVKNEDARRYIRQLPQYPRQPLAQVFPHVHPAAIDLVDKMLTVDPTKRITVEEALAHPYLEKLHDVADEPICMEPFSFDFEQQQLDEEQIKEMIYREALALNPEYA

SEQ ID NO: 6530 - protein, 558 aa, Arabidopsis lyrata
MASSVTGDAETVISADSSTKRSGGGWITFPFMIVTLLGLTIAAWGWLLNLIVYLIEEFNVKSIAAAQIANIVSGCICMVPAMAAIASDSFFGTIPVISVSAFISLMGVALLTLTASLDSLRPRACETASSLCQSPSKTQLGVLYTAITLASIGTGGTRFTLATAGANQYEKTKDQGSFFNWFFFTTYLAGAISATAIVYTEDNISWTLGFGLSVAANLFSFLVFISGKRFYKHDKPLGSPFTSLLCVIFAAVRKRKAVVSTNEKDYHNESITMPTKSFRFFNRAALKQEDEVKPDGSIRNPWRLCSVQQVEDFKAVIRIIPLALATIFLSTPIAMQLSLTVLQGLVMDRRLGPSFKIPAGSLQVITLLSTCLFIIVNDRFLYPFYQKLTGKFLTPLQRVGIGHAFNILSMAVTAIVEAKRLKIVQKGHFLGSSSVADMSVLWLFPPLVIVGIGEAFHFPGNVALCYQEFPESMRSTATSITSVVIGICFYTSTALIDLIQRTTAWLPDDINHGRVDNVYWVLVIGGVLNLGYFLACSLVYRYRNLKDDDHEQSANVSH

SEQ ID NO: 6531 - protein, 370 aa, Brassica oleracea
  misc_feature (345)..(345): Xaa can be any naturally occurring amino acid
  misc_feature (352)..(352): Xaa can be any naturally occurring amino acid
  misc_feature (354)..(355): Xaa can be any naturally occurring amino acid
  misc_feature (357)..(357): Xaa can be any naturally occurring amino acid
  misc_feature (363)..(363): Xaa can be any naturally occurring amino acid
MNNAGGQYPDFPAVQTHGGQFISYDIFGSLFEVTSKYRPPIVPIGRGAYGIVCSVLDSETNELVAMKKIANAFDNHMDAKRTLREIKLLRHLDHENIIAIRDVVPPPLRREFSDVYIATELMDTDLHQIIRSNQGLSEEHCQYFLYQLLRGLKYIHSAKVIHRDLKPSNLLLNANCDLKICDFGLARPTSENEFMTEYVVTRWYRAPELLLNSSDYTAAIDVWSVGCIFMELMNRKPLFPGKDHVHQMRLLTELLGTPTESDLGFTHNEDAKRYIRQLPNFPRQPLAKLFSHVNSLAIDLVDRMLTFDPNKRITVEEALNHPYLAKLHDPNDEPICLKPFSFDFXQQPLDEXQXXEXIYREAXALNPTYA

SEQ ID NO: 6532 - protein, 373 aa, Solanum tuberosum
MVDANMGGAQFPDFPKIVTHGGQYVQYDIFGNYFEITNKYRPPIMPIGRGAYGIVCSVFNAELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSAHVIHRDLKPSNLLLNANCDLKICDFGLARPNLENENMTEYVVTRWYRAPELLLNSSDYTAAIDVWSVGCIFMELMNRKPLFAGKDHVHQIRLLTELLGTPTESDLSFLRNEDAKRYVRQLPQHPRQQLATVFPHVNPLAIDLVDKMLTLDPTRRITVEEALAHPYLAKLHDAADEPVCPIPFSFDFEQQGIGEEQIKDMIYQEALALNPEYA

SEQ ID NO: 6533 - protein, 376 aa, Nicotiana benthamiana
MADANMGGGGGGQFPDFPSVLTHGGQYVQYDIFGNFFEITTKYRPPIMPIGRGAYGIVCSVLNTELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTEADLGFLQNEDAKRYIRQLPQHPRQQLANVFPHVNPLAIDLVDKMLTLDPTRRITVEEALDHPYLAKLHDAGDEPICPVPSSFDFEQQGIGEEQIKDMIYQEALSLNPEYA

SEQ ID NO: 6534 - protein, 376 aa, Silene vulgaris
MAEVAQNAAGNGAFPEFPATYTNGGQFIQYNIFGNMFEVTSKYRPPIMPIGRGAYGIVCSVLNTETNEMVAMKKIANAFDNYMDAKRTLREIKILRHFDHENVIALRDVVPPTLRREFTDVYIATELMDTDLHQIIRSNQNLSEEHCQYFLYQLLRGLKYIHSANVIHRDLKPSNLLINANCDLKICDFGLARPTAENEHMTEYVVTRWYRAPELLLNSSDYTAKIDVWSVGCIYMELMNRTPLFPGKDHVNQMRLLTELLGTPTESDLQFLHNEDARRYIRQLPPQPRQALGQLFSHIHPLAIDLVEKMLTFDPTKRISVEEALSHPYLARLHDTADEPTCTEPFSFEFEQQALGEEQMKEMIYQEALALNPEYA

SEQ ID NO: 6535 - protein, 373 aa, Solanum phureja
MVDANMSGAQFPDFPKIVTHGGQYVQYDIFGNYFEITNKYRPPIMPIGRGAYGIVCSVFNAELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSAHVIHRDLKPSNLLLNANCDLKICDFGLARPNLENENMTEYVVTRWYRAPELLLNSSDYTAAIDVWSVGCIFMELMNRKPLFAGKDHVHQIRLLTELLGTPTESDLSFLRNEDAKRYVRQLPQHPRQQLATVFPHVNPLAIDLVDKMLTLDPTRRITVEEALAHPYLAKLHDAADEPVCPIPFSFDFEQQGIGEEQIKDMIYQEALALNPEYA

SEQ ID NO: 6536 - protein, 370 aa, Arabidopsis thaliana
MNTGGGQYTDFPAVETHGGQFISYDIFGSLFEITSKYRPPIIPIGRGAYGIVCSVLDTETNELVAMKKIANAFDNHMDAKRTLREIKLLRHLDHENIIAIRDVVPPPLRRQFSDVYISTELMDTDLHQIIRSNQSLSEEHCQYFLYQLLRGLKYIHSANIIHRDLKPSNLLLNANCDLKICDFGLARPTSENDFMTEYVVTRWYRAPELLLNSSDYTAAIDVWSVGCIFMELMNRKPLFPGKDHVHQMRLLTELLGTPTESDLGFTHNEDAKRYIRQLPNFPRQPLAKLFSHVNPMAIDLVDRMLTFDPNRRITVEQALNHQYLAKLHDPNDEPICQKPFSFEFEQQPLDEEQIKEMIYQEAIALNPTYG

SEQ ID NO: 6537 - protein, 373 aa, Solanum lycopersicum
MVDANMGAAQFPDFPKIVTHAGQYVQYDIFGNLFEITNKYQPPIMPIGRGAYGIVCSVFNAELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSAHVIHRDLKPSNLLLNANCDLKICDFGLARPNVENENMTEYVVTRWYRAPELLLNSSDYTAAIDVWSVGCIFMELMNRKPLFAGKDHVHQIRLLTELLGTPTESDLSFLRNEDAKRYVRQLPQHPRQQLATVFPHVNPLAIDLVDKMLTLDPTRRITVEEALAHPYLAKLHDAADEPVCPIPFSFDFEQQGIGEEQIKDMIYQEALALNPEYA

SEQ ID NO: 6538 - protein, 371 aa, Arachis hypogaea
MAGVNPNGAADFPAVPTHGGQFIQYNIFGNLFEVTAKYRPPIMPIGRGAYGIVCSVLNTETNELVAVKKIANAFDNHMDAKRTLREIKLLRHLDHENVIGLRDVIPPPLRREFNDVYIATELMDTDLHHIIRSNQGLSEEHCQYFLYQILRGLKYIHSANIIHRDLKPSNLLLNANCDLKIIDFGLARPTLENDFMTEYVVTRWYRAPELLLNSSDYTSAIDVWSVGCIFMELMNKKPLLPGKDHVHQMRLLTELLGTPTEADLGLVKSEDARRYIRQLPQYARQPLARIFPHVHPLAIDLVDKMLTIDPTKRITVEEALAHPYLEKLHDIADEPVCMEPFSFDFEQQQLDEEQIKEMIYREALALNPEYA

SEQ ID NO: 6539 - protein, 352 aa, Arnica chamissonis
MADASGGGQYTEFPAVACHGGQFIRYNIFGNEFEITSKYRPPIMPIGRGAYGIVCSMLNSETNEMVAVKKIASAFDNYMDAKRTLREIKLLRHLDHENIISIKDIIPPPVRREFADVYITTELMDTDLHQIIRSNQNLSEEHCQYFLYQLLRGLKYIHSANVIHRDLKPSNLLLNANCDLKICDFGLARTSAENDFMTEYVVTRWYRAPELLLNSSDYTAAIDVWSVGCIFMELMNKKPLFPGKDHVHQMRLLTELLGTPTESDLRFIRNEDAKRYLAQLPQHPRQSLSKMFPHVHPLAIDLVDKMLTLDPTRRITVEDALDHPYLARLHDVADEPICMDPFSFEFEQQVLR

SEQ ID NO: 6540 - protein, 371 aa, Phaseolus coccineus
MAGVNPNGVADFPAVPTHGGQFIQYNIFGNLFEVTTKYRPPIMPIGRGAYGIVCSLLNTETNELVAVKKIANAFDNHMDAKRTLREIKLLKHLDHENVIALRDVIPPPLRREFNDVYIATELMDTDLHHIIRSNQSLSEEHCQYFLYQILRGLKYIHSANIIHRDLKPSNLLLNSNCDLKIIDFGLARPTLESDFMTEYVVTRWYRAPELLLNSSDYTSAIDVWSVGCIFMELMNKKPLFPGKDHVHQMRLLTELLGTPTDADLGLVKNEDARRYIRQLPQYPRQPLAQVFPHVHPAAIDLVDKMLTIDPTKRITVEEALAHPYLEKLHDVADEPICMEPFSFEFEQQQLDEEQIKEMIYREALALNPHYA

SEQ ID NO: 6541 - protein, 371 aa, Glycyrrhiza uralensis
MAGVNHNGVADFPAVPTHGGQFIQYNVFGNLFEVTAKYRPPIMPIGRGAYGIVCSLLNTETNELVAVKKIANAFDNHMDAKRTLREIKLLRHLDHENVIGLRDVIPPPLRREFNDVYITTELMDTDLHQIIRSNQNLSDEHCQYFLYQVLRGLKYIHSANIIHRDLKPSNLLLNANCDLKIIDFGLARPTLESDFMTEYVVTRWYRAPELLLNSSDYTSAIDVWSVGCIFMELMNKKPLFPGKDHVHQMRLLTELLGTPTEADIGLVKNEDARRYIRQLPQYPRQPLNRVFPHVHPSAIDLVDKMLTVDPTKRITVEEALAHPYLEKLHDVADEPVCTEPFSFEFEQQQLDEEQIKEMIYREALALNPEYA

SEQ ID NO: 6542 - protein, 370 aa, Malus domestica
MADLVPTNGDFAAVPSHGGQYIQYNIFGNLFEITNKYRPPIMPIGRGAYGILCSVLNSETKEMVAIKKIANAFDNHMDAKRTLREIKLLRHLDHENVIAIKDVIPPPLRREFSDVYIAMELMDTDLHQIIRSNQGLSEEHCQYFLYQILRGLKYIHSANVIHRDLKPSNLVLNANCDLKICDFGLARPTAENELLTEYVVTRWYRAPELLLSSSDYTAAIDVWSVGCIFMELMNRKPLFPGKDHVHQMRLLTELLGTPTESDLGFVRNEDARRYIRQLAPLPRQPLERLFPHVNPMAINLIDRMLTFDPTKRITVEQALAHPYLERLHDIADEPICTKPFSFDFEQQPLGEEQMKDMIYREAIALNPEYA

SEQ ID NO: 6543 - protein, 365 aa, Ipomoea batatas
MVGGGDFLAVQTHGGQYVQYDIFGNLFEVTSKYAPPITPIGRGAYGIVCSALNAETNEMVAIKKIADAFDNFMDAKRTLREIKLLRHLEHENVIAIKDVIPPPLRREFNDVYIATELMDTDLHQIIRSNQGLSEEHCQYFLYQILRGLKYIHSANVIHRDLKPSNLLLNSNCDLKICDFGLARTNLDNEFMTEYVVTRWYRAPELLLNSSDYTAAIDVWSVGCIFMELMNRKPLFQGKDHVHQMRLITELLGTPTDSDLGSIQNENARRYIRQLPLRPRQQLANGFPHVHPLAIDLMDKMLTFNPSKRITVEEALAHPYLAQLHDKSDEPICPVPFTDFEKQAYGEEQIKDMIYQEALAMNPGYA

SEQ ID NO: 6544 - protein, 370 aa, Populus trichocarpa
MANYAPGNGDFPAIPTNGGQFIQHNIFGNLFEITSKYRPPITPIGRGAYGIVCSVLNSETNEKVAIKKIANAFDNYMDAKRTLREIKLLRHLDHENVIGIRDVIPPPLRREFTDVYIATELMDTDLHHIVRSNQGLSEEHCQYFLYQTLRGLKYIHSANVIHRDLKPSNLLVNANCDLKICDFGLARPTSENEFMTEYVVTRWYRAPELLLNSSDYTAAIDVWSVGCVFMELMNRKPLFPGKDNVHQMRLLTELLGTPTESDLGFVRNEDARRYIRQLDSHPHRSLAELFPLFQPLAIDLVDKMLTFDPTRRITVEEALAHPYLARLHDIADEPVCPEPFSFEFEQQPLTEEQMKDMVYEEAIAFNPEYA

SEQ ID NO: 6545 - protein, 366 aa, Manihot esculenta
EMANGEFPAVPTHGGQFIQYDIFGNLFEITSKYQPPIMPIGRGAYGIVCSVLNSETNEMVAIKKIANAFDNHMDAKRTLREIKLLRHFDHENVVAIRDVIPPPLRREFTDVYIATELMDTDLHQIIRSNQGLSEEHCQYFLYQILRGLKYIHSANIIHRDLKPSNLLLNANCDLKICDFGLARPTAENEFMTEYVVTRWYRAPELLLNSTDYTDAIDVWSVGCIFMELMNRRPLFPGNDHVHQLRLLTELLGTPTEADLGFVRSEDARRYIRQLSQYPRQPLAQVFPRVNPLAIDLIDRMLTFDPTRRISVEEALAHPYLARLHDVADEPVCPVPFTFDFEQQPLGEEQMKEMIYREALALNPEYA

SEQ ID NO: 6546 - protein, 376 aa, Gossypium hirsutum
MANVAPGNAGGHFGDFPAFHTYGGQFIQYSIFGNLFEITSKYRPPITPIGRGAYGIVCSVLNSETNEMVAVKKIANAFDNHMDAKRTLREIKLLRHLDHENVIAIRDVIPPPLRRDFNDVYIALELMDTDLHQIIRSNQSLSEEHCQYFLYQLLRGLKYIHSANVIHRDLKPSNLLLNANCDLKICDFGLARPASENEFMTEYVVTRWYRAPEILLNSSDYTAAIDVWSVGCIFMELMNRKPLFPGNDHVHQMRLLTELLGTPTESDLGFLQNEDARRYIRQLPAYPRQQLANVFPHVNRMALDLIDRMLTFDPTRRITVEEALAHPYLERLHDIADEPVCPEPFNFDFEQQPLGEEQMKDMIYREALALNPDYAR

SEQ ID NO: 6547 - protein, 237 aa, Platanus occidentalis
MNGVPPQNTNAGQMADFPAVPKHDGRFIEYNIFGNLFEITVKYRPPIMPIGRGAYGIVCSVLNSETNEMVAIKKIANAFDNHMDAKRTLREIKLLRHLDHENVIGIRDVIPPPVPRAFCDVYIATELMDTDLHQIIRSNQELSEEHCQYFLYQILRGLKYIHSANVIHRDLKPSNLLLNANCDLKICDFGLARPTAENEFMTEYVVTRWYRAPELLLNSQITPLQLMFGLWDASIWS

SEQ ID NO: 6548 - protein, 371 aa, Pisum sativum
MAGVNQNGVAEFPAVQTHGGQFVQYNVFGNLFEVTAKYRPPIMPIGRGAYGIVCSLLNTETNELVAVKKIANAFDNHMDAKRTLREIKLLRHLDHENVIGLRDVIPPPLRREFNDVYITTELMDTDLHQIIRSNQNLSDEHCQYFLYQILRGLRYIHSANIIHRDLKPSNLLLNANCDLKIIDFGLARPTMENDFMTEYVVTRWYRAPELLLNSSDYTSAIDVWSVGCIFMELMNKKPLFPGKDHVHQMRLLTELLGTPTDADVGLVKNEDARRYIRQLPQYPRQPLNRVFPHVHPLAIDLIDKMLTIDPTRRITVEEALAHPYLEKLHDVADEPICMEPFSFEFEQQHLDEEQIKEMIYREALALNPEYA

SEQ ID NO: 6549 - protein, 403 aa, Triticum aestivum
MPLPSSSSAAAVAAGPAASPLAARSRGRLLRARSGHAAVRCQRVDPVRLRAVNGSPPCVPLSDRSPWTPATMPIFGDANIRKDDTRLRIFSGTANPSLAQEIASYMGLELGKVNIKRFADGEIYVQLQESVRGCNVFLVQPSCPPANENLMELLIMIDACRRASAKNITAVIPYFGYARADRKSQGRESIAAKLVANMITEAGANRVLVCDLHSSQAMGYFDIPVDHVYGQPVILDYLASKTISSNDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEEKNFPQLTILSVANLLGETIWRVHDDCSVGHAPYSTLDID

SEQ ID NO: 6550 - protein, 401 aa, Brachypodium distachyon
MPLPSSSSAAAIAAGPAASPLAARSLRGRPRSSPFFVKCQRVDPLKLRAVNGAPPCIPVPDSSLWTPITMPVFGDNKVRKDGTRLRIFSGTANPSLSQEIASYMGLELGKINIKRFADGEIYVQLQESVRGCDVFLVQPSCPPANENLMELLIMIDACRRASAKNITAVIPYFGYARSDRKSQGRESIAAKLVANMITEAGANRVLVSDLHSSQAMGYFDIPVDHVYGQPVILDYLASKTICSNDLVVVSPDVGGVARARAFAKKLSDAPLAIVDKRRHGHNVAEVMNLIGDVKGKVAVMMDDMIDTAGTIAKGAELLHQEGAREVYACCTHAVFSPPAIERLSSGLFQEVITTNTIPLKEDKNFPQLTILSVANLLGETIWRVHDDCSVGHEPYSTLDID

SEQ ID NO: 6551 - protein, 398 aa, Panicum virgatum
MPLCHSPTSAAVAAAASPIAARSGGLLRRSRPAPAVVRCKKLDSLRAINGSPPCIPVPDRSLLTPVTLPVFPDPSMRNDTRLRIFSGTANHSLSQEIASYLGLELGKINIKRFADGEIYVQLQESVRGCDVFLVQPTCPPANENLMELLIMIDACRRASAKNITAVIPYFGYARADRKSQGRESIAAKLVANMITEAGANRVLVCDLHSSQAMGYFDIPVDHVYGQPVILDYLASKTICSNDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEEKTFPQLTILSVANLLGETIWRVHDDCSVGHEPYSSLDID

SEQ ID NO: 6552 - protein, 396 aa, Oryza sativa
MPLSYSAAAAAAPSPLAARSRGLLRRPPRSSPVVVRCKKIDQLRAVNGIPPYAPVSNRSLLSPVTLPIIRDANIKNDTRLRIFSGTANPSLSQEIASYLGLELGKINIKRFADGEIYVQLQESVRGCDVFLVQPTCPPANENLMELLIMIDACRRASAKNITAVIPYFGYARADRKSQGRESIAAKLVANMITEAGANRVLVCDLHSSQAMGYFDIPVDHVYGQPVILDYLASKTICSDDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEDKSFPQLTILSVANLLGETIWRVHDDCSVGHEPYSSLDID

SEQ ID NO: 6553 - protein, 398 aa, Sorghum bicolor
MPLCCSPTSAAAAAAASPGVARSGGLLRRSRPVPGVVRCKKIDSLRAINGALPCIPVSDRSLLTPVNLPVFRDPNMRNDTRLRIFSGTANPSLSQEIASYLGLELGKINIKRFADGEIYVQLQESVRGCDVFLVQPSCPPANENLMELLIMIDACRRASAKNITAVIPYFGYARADRKSQGRESIAAKLVANMITEAGANRVLVCDLHSSQAMGYFDIPVDHVYGQPVILDYLASKTICSNDLVVVSPDVGGVARARAFAKKLSDAPLAIVDKRRQGHNVAEVMNLIGDVRGKVAVMMDDMIDTAGTIAKGAELLHQEGAREVYACCTHAVFSPPAIERLSSGLFQEVIITNTIPLKEEKTFPQLTILSVANLLGETIWRVHDDCSVGHEPYSSLDID

SEQ ID NO: 6554 - protein, 399 aa, Zea mays
MPPCCSPTTSAVTAAAASPGASRSGGLLRRSRPAPAAVNCKKIDSLRSINGAPPCIPVSNRSLLTPVTLPVFRDPNMRNDTRLRIFSGTANPSLSQEIASYLGLELGKITIKRFADGEIYVQLQESVRGCDVFLVQPSCPPANENLMELLIMIDACRRASAKNITAVIPYFGYARADRKSQGRESIAAKLVANMITEAGANRVLVCDLHSSQAMGYFDIPVDHVYGQPVILDYLASKTICSDDLVVVSPDVGGVARARAFAKKLSDAPLAIVDKRRQGHNVAEVMNLIGDVRGKVAVMMDDMIDTAGTISKGAELLHQEGAREVYACCTHGVFSPPAIERLSSGLFQEVIITNTIPLKEEKSFPQLTILSVANLLGETIWRVHDDCSVGHEPYSSLDID

SEQ ID NO: 6555 - protein, 669 aa, Brachypodium distachyon
MAAAPPADGQEKVIAAAQHIVKSLANSKNAADDMIRILSGFDNRFSLMSDLFPAPPNAGPGCGSVPEDEGEGGGGAYGEEDDYQREGPGPSGGGDDEDDERDAAVEEAVRVVEQWDSPAAGDRLVFESSEDAEEYLGAAACLVGAAGPRVEAALQVAMARLEEEFRQLLIRGTSSLAAEDLHASLLRRLSLTVPTFYSAAGDLDCPSFASHGEEGDESAGAGRWSSVSDGEISPYLIAPDTVSALRDIADVMLRAGYSPELCQVYSEVRRDTLMECLAVLGVDKMSLEEVQRVEWGVLDGKMKKWIQALKVVVQGLLAEERRICSQILASDADAEEECFTEAAKGCVLQLLNFGDAIAIGKRSSEKLFRILGMYEALAELLPELEALFSGEARDFIKEEAEGILVRLGDAVRGTVAEFANAIRGETSRRPLPGGEIHPLTRYVMNYVRLLADYSRWLNDLLDGCESELETGGENVDMTPLGHCVLILITNLLDKIEDKSKLYDDEALQNIFLMNNLWYIVQKVKDSELKTLLGDNWIRKRRGQIRRYSTGYLRSSWTRVLACLRDDGLPQATGSSSALKAALKERFKNFNLTYEELYRTQTAWRVVDPQLREELKISISEKVLPAYRSFVGRFRGQLEGGRNFAKYIKYNPEDVENQVSDFFEGKRLNA

SEQ ID NO: 6556 - protein, 702 aa, Triticum aestivum
  misc_feature (100)..(100): Xaa can be any naturally occurring amino acid
  misc_feature (229)..(229): Xaa can be any naturally occurring amino acid
  misc_feature (233)..(233): Xaa can be any naturally occurring amino acid
  misc_feature (242)..(242): Xaa can be any naturally occurring amino acid
  misc_feature (249)..(249): Xaa can be any naturally occurring amino acid
  misc_feature (252)..(252): Xaa can be any naturally occurring amino acid
  misc_feature (254)..(254): Xaa can be any naturally occurring amino acid
PTLPASAPLLPPRLRCPLSQLPPPIGEAQAARRGAGDGMAAAPPDGQEKVIAAAQQIVKSLANSKNAADDMIRILSGFDNRFSLMSDLFPAAGAGGAAVXSEPLPEGDYAREGLPGPGGGDGFGDDDDLEDERDAAVEDALRLVEQWDSPAAGDRLVFESPEDAEEYLAAAACLMGEAGPRVEAALQVAMARLEEEFRQLLIRGTASLAARTCTRPSSAACRSRCPPSXPPPXSTSTAPPSXATPTRAXSPXPXPDGAPPPTARSRPTSFPPTPFSTLKDIADVMLRAGYGPELCQVYSEVRRDTLMECLAVLGVDKMSLEEVQRVEWGVLDGKMKKWIQALRVVVQGLLAEERRICGQILAADADAEEECFTEAAKGCVLQLLNFGDAIAIGKRSSEKLFRILGMYEALAELLPELEALFSGDARDFIKEEAEGILVRLGDAVRGTVAEFANAIRGETSRRSLPGGEIHPLTRYVMNYVRLLADYSRWLNHLLDGCETELENGGDNADMTPLGHCLLILITHLLDKIEDKAKLYDDEALQNIFLMNNLWYVVQKIKDSELKSLLGDNWIRKRRGQIRRYSTGYLRSSWTRVLACLRDDGLPQTTGSSSALKAALKERFKSFNLAYEELYRTQTAWKVVDPQLREELKISISEKVLPAYRSFVGRFRGQLEGGRNFAKYIKYNPEDVENQVSDFFEGKKLNA

SEQ ID NO: 6557 - protein, 448 aa, Triticum aestivum
MSAGATVNWIRTPFHTQRFHDFSSLSFRCRNTFGSIQPCWLATDQDSSLSKVRVAADYSDSVPDSKYMRDRGYHPLEEIKERPKKKDISLTDVETARTVVEANSKGLLVFPARVHNEPHGHVSWSEFQYAVDDYGDIFFQVPDDGNILEDDDANNPVTVLIGTDGAIIGETSAVTSDFSDHVVVEDSMDMHDNDSKVDTEITDILIEWGMPVTMRSIHPIYFAKCLTKAVHDNHGEKIDNPSNGVSIVGYLRPAFIEEESYLRSLFGAECSADGYSSNWREEYNREPRPASGTNGLIDGDKSKSDINDTESSIDSTIYKLEMMSIELFSVYGKQFMIDPQDFQDAEPDLLSNHASDIIKRVKENSDQCTMALRSLCSRKKGLTVEDASLIGVDSLGIDVRAFSGLEARTVRFSFNAQALSERSAEKKIKRMLFPRYRKTVKASAEDEC

SEQ ID NO: 6558 - protein, 448 aa, Brachypodium distachyon
MSAGATINWIKTPFGTRRCHDFSSLSFRCRNTFGSIQPCWFATDKESSLSKVRVAADYSDSVPDSKYMRERGYHPLEEVKERPKKKDLSLTDVETARTVVEANSKGLLVFPARVHNEPHGHVAWSEFQYVVDDYGDIFFQVPDNGNILDDDDANNPVTVLIGTDGAIIGETSVVTSDFSDHMDIEDSMDMRDDYSKIDTEITDILIEWGMPVTMRAIHPIYFAKCLTKAIHDNHGEKMDNPSNGVSIVGYLRPAFIEEESYLRSLFRAECNADGQSSNWREEHHREPVSAYGTNGLIDDDKSRIDSSDAGSSMESMIYKLEIMTIELFSIYGKQLMIDPQDFQDAEPDLLTNYAPDIIKRIKENNDQCTMALRSLCSRKKGLAVEGASLIGVDSLGIDVRAFSGLEARTVRFSFNAQALSERSAEKKIRRMLFPRYRKSVKVPAEDEC

SEQ ID NO: 6559 - protein, 448 aa, Oryza sativa
MAAGVTFNWIKTPLDIRRFHDFSSLSFRCRNTFGSIQPSWLTTDQEPSFSKVRVAADYSDSVPDSKYTRDRGYHPLEEVKERPKKKDLSLTDVETARTVVEANSKGLLVFPARVHNEPHGHVAWSDFQYIVDDYGDIFFQVPDSENILEDDAANNPVTVLIGMDGPIIGETSVVTSDFSDYMDVENFIDMPDENDSKIDTEITDILIEWGMPATMRAIHPIYFAKCLTKAVHDKHREKMDSPSNGVSIVGYLRPAFIEEESYLRSLFHGECNGDGYSSDWRDECKREPAPASGTNGLIDDDKSRFDFTNVGSSTDSTIYKLEIMTVELFSIYGKQLMIDPQDFQDAEPDILANSASEIINRIKENDDQCAMALRSLCHRKKGLTVEEASLISIDSLGIDVRAFSGLEARTVRFSFNAQALSERSAEKKIRRMLFPRRKNVKPSTEDEC

SEQ ID NO: 6560 - protein, 1373 aa, Brachypodium distachyon
MGSLTAAAEEGTAATAIAAEDWSAEAVIYVNGVRRVLPDGLAHLTLLQYLRDIGLRGTKLGCGEGGCGACTVMVSCYDQITKKSEHFAINACLAPLYSLEGMHIITVEGIGDRQRGLHPVQECLAKAHGSQCGFCTPGFVMSMYALLRSSKDPPTEEQIEDSLAGNLCRCTGYRPIIDAFRVFAKTDDSLYTDSPSENANGQAICPSTGKPCSCRNETDVSTNESLLLSSAKIYLPCSYNEIDGNAYNEKELIFPPELQLRKFMPLKLNGFNGIRWYRPLKLQQLLHLKSCYPDAKLIIGNSEVGVETKFKNAQYKVMVSVSHVPELHTLKVEEDGLRIGSAVRLARLQNFLKKVIIERGSDETSSCQAILRQLKWFAGTQIRNVASVGGNICTASPISDLNPLWMATGAKFQIIDVNNNVRITAAKDFFLGYRKIDLKPDELLLSVMLPWTRQFEYVKEFKQAHRREDDIALVNAGMRVHIREAEGKWIVSDVSIVYGGVAAVPLTATKTENFLTGKKLDSGLLDETFGLLKEDIPLAENAPGGMVEFRSSLTLSFFFKFFLYVTHEMNIKGLLKDEMHAANLSAIQSYTRPVTVGTQDYESVRQGTAVGQPMIHMSAMLQVTGEAEYTDDTPTPPNTLHAALVLSKKPHARILSIDDSLAKSSPGFAGLFLSKDVPGANHTGPIIHDEEIFASDIVTCVGQIIGIVVADTHDNAKAAANKVNIEYSELPAILSIEEAIKAGSFHPNTNRCLEKGDVGECFLSNTCDKIIEGEVQVGGQEHFYMEPQCTLVWPVDSGNEIHMISSTQAPQKHQKYVAYALGLPLSKVVCKTKRIGGGFGGKETRSAIFAAAASVASYCLRRPVKIVLDRDIDMMTTGQRHSFLAKYKVGFTNGGKIVALDLEIYNNGGNSLDLSLSVLERAMFSSDNVYDISNIRVSGQVCFTNFPSNTAFRGFGGPQGMLIAENWIQHMATELKRSPEEIKELNFQSEGIVLHYGQLLQNCTIHSVWDELKASCNFVEARKDVNSFNGNNRWRKRGIAMVPTKFGISFTAKFMNQAGALVQVYTDGTVLVTHGGVEMGQGLHTKVAQVAASSFSIPLSSVFISETSTDKVPNASPTAASASSDLYGAAVLDACQQIKARMEPIASRGNHKSFAELAQACYMERVDLSAHGFYITPDIGFDWMVGKGTPFNYFTYGSAFAEVEIDTLTGDFHTRTADIVMDLGYSINPAIDIGQIEGAFIQGLGWAAMEELKWGDDNHKWIRPGHLFTCGPGSYKIPSVNDIPLKFKVSLLKGVPNPKAIHSSKAVGEPPFFLASAVLFAIKDAIAAARAEEGHVDWFPLDNPATPERIRMACVDSITKKFASVYYRPKLSI

SEQ ID NO: 6561 - protein, 1371 aa, Sorghum bicolor
MGSLTRAAEEDPAAAAEEEWSDEAVIYVNGVRRVLPDGLAHLTLLQYLRDIGLRGTKLGCGEGGCGACTVMVSCYDRITKKSLHFAINACLAPLYSVEGMHIITVEGIGDRQRGLHPVQECLAKAHGSQCGFCTPGFVMSMYALLRSSKQPPTEDQIEDCLAGNLCRCTGYRPIIDAFRVFAKTDNLAYTNSSSENTNDQAICPSTGKPCSCRNETDINVNESSLPSSVERYSPYSYNEIDGSAYNERELIFPPELQLRKVMPLKLNGFNEIKWYRPLKLKQLLHLKSCYLDAKLIIGNSEVGVETKFKNAQYNVMISVTHIPELNTLKVKEDGIHIGSAVRLAQLQNFLKKIIAERDLPETSSCQAIVRQLKWFAGTQIRNVASVGGNICTASPISDLNPLWIAVGAKFQIIDVNSNVRTILAKDFFLGYRKVDIKPEEILLSIILPWTRPFEYVKEFKQAHRREDDIALVNAGMRVYLQEAEGNWIISDVSIVFGGVAAVPLSASRTENFLTGKKLDSGLLDDTFNLLKEDISLSENAPGGMIEFRRSLTLSFFFKFFLSVTHEMKVKGLLEDGLHADHLSAVQPYSRPVTVGTQSYELVRQGTSVGQPMVHMSAMLQVTGEAEYTDDTPTPPNTLHAALVLSKKAHARILSIDDSLAKSSPGFAGLFLSKDIPGVNHTGPVIHDEEFFASDIVTCVGQIIGIVVADTHDNAKTAANKVHIEYCELPAILSIEEAVKNGSFHPNTKKCLVKGDVEQCFLSGACDRIVSGQVHVGGQEHFYMEPQCTLVWPVDSGNEIHMVSSTQAPQKHQKYVASVLGLPQSKVVCKTKRIGGGFGGKETRSAIFAAAASVPSFCLRRPVKLVLDRDVDMISSGQRHSFLGKYKVGFTNEGKILALDLEIYNNGGHSLDLSLAVLERAMFHSENVYDIANIRINGQVCFTNFPSNTAFRGFGGPQGLLIAENWIHHIATELQRSPEEIKELNFHNDGVVLHYGQLLQNCTIGSVWDELKSSCNFVEARKAVNSFNSNSRWRKRGIAMIPTKFGISFTAKFMNQAGALVQVYTDGTVLVTHGGVEMGQGLHTKIAQVAASSFNIPLSSVFISETSTDKVPNASPTAASASSDLYGAAVLDACQQIKVRMEPIASKGTHNSFAELAQACYMERVDLSAHGFYATPNIGFDWTIGKGTPFNYFTYGAAFAEVEIDTLTGDFYTRTADIVMDLGFSINPAIDIGQIEGAFVQGLGWAAMEELKWGDDNHKWIRPGHLFTCGPGSYKIPSVNDIPLNFKVSLLKGVPNPKAIHSSKAVGEPPFFLGSAVLFAIKDAIFAARAEEGHLEWFPLDNPATPERIRMACVDSITKKFAGIDYRPKLSV

SEQ ID NO: 6562 - protein, 1369 aa, Oryza sativa
MGSLTRAEEEETAAAEEWSGEAVVYVNGVRRVLPDGLAHLTLLQYLRDIGLPGTKLGCGEGGCGACTVMVSCYDQTTKKTQHFAINACLAPLYSVEGMHIITVEGIGNRQRGLHPIQERLAMAHGSQCGFCTPGFVMSMYALLRSSEQPPTEEQIEDSLAGNLCRCTGYRPIIDAFRVFSKRDDLLYNNSSLKNADGRPICPSTGKPCSCGDQKDINGSESSLLTPTKSYSPCSYNEIDGNAYSEKELIFPPELQLRKVTSLKLNGFNGIRWYRPLKLKQVLHLKACYPNAKLIIGNSEVGVETKFKNAQYKVLISVTHVPELHTLKVKEDGIHIGSSVRLAQLQNFLRKVILERDSHEISSCEAILRQLKWFAGTQIRNVASVGGNICTASPISDLNPLWMATGATFEIIDVNNNIRTIPAKDFFLGYRKVDLKPDEILLSVILPWTRPFEFVKEFKQAHRREDDIALVNAGMRVYIRKVEGDWIISDVSIIYGGVAAVSHRASKTETFLTGKKWDYGLLDKTFDLLKEDVVLAENAPGGMVEFRSSLTLSFFFKFFLHVTHEMNIKGFWKDGLHATNLSAIQSFTRPVGVGTQCYELVRQGTAVGQPVVHTSAMLQVTGEAEYTDDTPTPPNTLHAALVLSTKAHARILSIDASLAKSSPGFAGLFLSKDVPGANHTGPVIHDEEVFASDVVTCVGQIVGLVVADTRDNAKAAANKVNIEYSELPAILSIEEAVKAGSFHPNSKRCLVKGNVEQCFLSGACDRIIEGKVQVGGQEHFYMEPQSTLVWPVDSGNEIHMISSTQAPQKHQKYVANVLGLPQSRVVCKTKRIGGGFGGKETRSAIFAAAASVAAYCLRQPVKLVLDRDIDMMTTGQRHSFLGKYKVGFTDDGKILALDLDVYNNGGHSHDLSLPVLERAMFHSDNVYDIPNVRVNGQVCFTNFPSNTAFRGFGGPQAMLIAENWIQHMATELKRSPEEIKELNFQSEGSVLHYGQLLQNCTIHSVWDELKVSCNFMEARKAVIDFNNNNRWRKRGIAMVPTKFGISFTTKFMNQAGALVQVYTDGTVLVTHGGVEMGQGLHTKVAQVAASSFNIPLSSIFISETSTDKVPNATPTAASASSDLYGAAVLDACQQIMARMEPVASRGNHKSFAELVLACYLERIDLSAHGFYITPDVGFDWVSGKGTPFYYFTYGAAFAEVEIDTLTGDFHTRTVDIVMDLGCSINPAIDIGQIEGGFIQGLGWAALEELKWGDDNHKWIRPGHLFTCGPGSYKIPSVNDIPLNFKVSLLKGVLNPKVIHSSKAVGEPPFFLGSAVLFAIKDAISAARAEEGHFDWFPLDSPATPERIRMACVDSITKKFASVYYRPKLSV

SEQ ID NO: 6563 - protein, 1370 aa, Zea mays
MGSLTRVPAEDPAAAEEEWSDEAVIYVNGVRRVLPDGLAHLTLLQYLRDIGLRGTKLGCGEGGCGACTVMVSCYDRITKKSLHFAINACLAPLYSVEGMHIITVEGIGDRQRGLHPVQECLAKAHGSQCGFCTPGFVMSMYALLRSSKQPPTEDQIEDCLAGNLCRCTGYRPIIDAFRVFAKTDNLAYTNSCSEDAKDQAICPSTGKPCSCRNETDVNVNESSLSSSVERYSPYSYNEIDGSAYNERELIFPPELQLRKVMPLKLNGSNEIKWYRPLKLKQLLHLKSCYLDAKLIIGNSEVGVETKFKNAQYKVLIAVTHIPELNTLKAKEDGIHIGSAVRLAQLQNFLKKVVAEHDLPETSSCQAIVRQLKWFAGTQIRNVASIGGNICTASPISDLNPLWIAVGAKFHIIDVNGNVRTTLAKDFFLGYRKVDIKPEEILLSIILPWTRPFEYVKEFKQAHRREDDIALVNAGMRVYLQETERNWIISDVSIVFGGVAAVPLSASRTENFLTGKKWDSGLLDDTFNLLKEDISISENAPGGMIEFRRSLTLSFFFKFFLSVTHEMKIKGLLADGLHADHLSAVQPYSRPVTVGTQSYELVRQGASVGQPMVHMSAMLQVTGEAEYTDDTPTPPNTLHAALVLSKKAHARILSIDDSLAKSSPGFAGLFLSKDIPGVNHTGPIIHDEEFFASNIVTCVGQIIGIVVADTHDNAKTAANKVHIEYCELPAILSIEEAVKIGSFHPNTKKCLVKGDVEQCFLSGACDRIVSGQVHVGGQEHFYMEPQCTLVWPVDSGNEIHMVSSTQAPQKHQKYVASVLGLPQSKVVCKTKRIGGGFGGKETRSAIFAAAASVPSFCLRRPVKLVLDRDVDMISTGQRHSFLGKYKVGFTNEGKILALDLEIYNNGGHSLDLSLAVLERAMFHSENVYDIENIRINGQVCFTNFPSNTAFRGFGGPQGLLIAENWIHHIATELQRSPEEIKELNFHNDGVVLHYGQLLQNCTISSVWDELKASCNFVEARKAINNFNSNNRWRKRGIAMIPTKFGISFTAKFMNQAGALVQVYTDGTVLVTHGGVEMGQGLHTKVAQVAASSFNIPLSSVFISETSTDKVPNASPTAASASSDLYGAAVLDACQQIKVRMEPIASKGTHNSFAELAQACYMERVDLSAHGFYATPNIGFDWTIGKGTPFNYFTYGAAFAEVEIDTLTGDFYTRTADIVMDLGFSINPAIDIGQIEGAFIQGLGWAAIEELKWGDDNHKWIRPGHLFTCGPGSYKIPSVNDIPLNFKVSLLKGVPNPKAIHSSKAVGEPPFFLGSAVLFAIKDAISAARAEEGHLDWFPLDNPATPERIRMACVDSITKKFAGIDYRSKLSV

SEQ ID NO: 6564 - protein, 350 aa, Brachypodium distachyon
MGRWRRVSVVALVLLLFSACHGRELFVKNHEQSFIYDHTLAKTLVEYASAVYMTDLTALYTWTCSRCNDLTQDFEMRSLIVDVENCLQAFVGVAHNLNAIIVAIRGTQENSVQNWIKDLVWKQLDLSYPNMPNAKVHSGFFSSYNNTILRLAITSAVHKARETYGDINIIVTGHSMGGAMATFCALDLAINLGRDDVQLMTFGQPRVGNAAFASCFAKYVPNTIRLVHGHDIVPHLPPYISFLPHLTYHHFPREVWVHDSEGNTTEQICDASGEDPNCCRCLSILSLSIQDHFTYLGVDMEADDWSTCRIITAQSVERFQKDLASNIIMKNHDVDVSIVGGSEDRRNSFR

SEQ ID NO: 6565 - protein, 352 aa, Sorghum bicolor
MERCSLGASVVALLLLLSGASHGRELPVEDSDHSFIYNHTLAKTLVEYASAVYMTDLTSLFTWTCSRCNDLTQGFEMRSLIVDVENCLQAFVGVAHNLNSIIVAIRGTQENSVQNWLKDLIWKQLDLSYPGMPNAKVHSGFFSSYNNTILRLAITSAVNKARKSYGDINVIVTGHSMGGAMASFCALDLAMKLGSDSVQLMTFGQPRVGNAAFASCFAKYVPNTIRVTHGHDIVPHLPPYFSFLPHLTYHHFPREVWVQDSDGNITEKICDDSGEDPDCCRCLSMFSLRIQDHFTYLGVDMEADDWSTCRIITAQSVRQFRRELASNIIMTKHDIDVSIVEPSVQTDRSSSS

SEQ ID NO: 6566 - protein, 351 aa, Panicum virgatum
MGRWTCTGVVALIILLSAASHGRELPVKKSGQSFVYNHTLAKTLVEYASAVYMTDLTALYTWTCSRCNDLTQGFEMRSLIVDVENCLQAFVGVAHDLNSIVVAIRGTQENSVQNWFKDLIWKQLDLRYPNMPNAKVHSGFFSSYNNTILRLAITSAVRKARKSYGNINVIVTGHSMGGAMASFCALDLAMKLGSDSVQLMTFGQPRVGNAAFASYFSKYVPNTIRVTHGHDIVPHLPPYFSFLSQLTYHHFPREVWVHDSKGNTTEQICDNSGEDPKCCRCVSMFSLSIQDHFTYLGVDMEADDWSTCRIIGAQSVQKFRKELTSSIIMTMHNVDVSIVEPSVQTDLSSFR

SEQ ID NO: 6567 - protein, 351 aa, Pennisetum glaucum
MGRWRCAGVVALVLLLSAASHGRELPVKKSDHSFVYNHTLAKTIVEYASAVYMSDLTALYTWTCSRCNDLTQGFEMRSLIVDVENCLQAFVGVAHNLNSIVVAIRGTQENSVQNWIEDLVWKQLDLSYPNMPNAKVHRGFFSSYNNTILRLAITSAVRKARKSYGDINVIVTGHSMGGAMASFCALDLAMKLGSDRVQLMTFGQPRVGNAAFASCFAKYVPNTIRVTHGHDIVPHLPPYFSFIPQWTYHHFPREVWVQDSNGNTTVKICDDSGEDPHCCRSISMFSLSIQDHFTYLGVDMQADDWSTCRIIAAESVKQFRKDLTSNIIMAKHNADISIVEPSVQTDRSSSR

SEQ ID NO: 6568 - protein, 351 aa, Zea mays
MERWSLGAKVVALALLLSAASHGRELPVKSSDRSFIYNHTLAKTLVEYASAVYMTDLTALFTWTCSRCNDLTQGFEMRSLIVDVENCLQAFVGVDHSLNSIIVAIRGTQENSVQNWIKDLIWKQLDLSYPNMPNAKVHSGFFSSYNNTILRLAITSAVHKARKSYGDINVIVTGHSMGGAMASFCALDLAMKLGGGSVQLMTFGQPRVGNAAFASYFAKYVPNTIRVTHGHDIVPHLPPYFSFLPQLTYHHFPREVWVQDSDGNTTERICDDSGEDPDCCRCISMFGLRIQDHFTYLGVDMEADDWSTCRIITAQRVQQFRLELAGNIMMTKHDIDVSIVEPSVQNRLEQF

SEQ ID NO: 6569 - protein, 346 aa, Oryza sativa
MERWRCVSVLALVLLLSNASHGRDISVQHSQQTLNYSHTLAMTLVEYASAVYMTDLTALYTWTCSRCNDLTQGFEMKSLIVDVENCLQAFVGVDYNLNSIIVAIRGTQENSMQNWIKDLIWKQLDLSYPNMPNAKVHSGFFSSYNNTILRLAITSAVHKARQSYGDINVIVTGHSMGGAMASFCALDLAINLGSNSVQLMTFGQPRVGNAAFASYFAKYVPNTIRVTHGHDIVPHLPPYFSFLPHLTYHHFPREVWVNDSEGDITEQICDDSGEDPNCCRCISTWSLSVQDHFTYLGVDMEADDWSTCRIITAENVRQLQKDLASNIIVSKHSVDVTIVEPSSQTY

SEQ ID NO: 6570 - protein, 527 aa, Avena sativa
MELATAAVVSTASTHPGRTNSFSSPRAASWSVSSLPSSSLSLSTSASASRFQRRRGAVVSAAVELREASAGGGDSVRVTETPQPNSSVKFSVEVPPSICQECYQTTLMEYSKRFKVPGFRPGKIVPENVLLNYVGPQHVRAATVEAILRHTLPQALSSVEDKALEDSVQILTKFDDMNESFSLDHVFRYDVAVDVVPELQWLSEDKYKNLKVVIEIDEIVDAEKAAELELKRRRKSLGGLRVVSDRGLQVGDVTVIDILAETITTDGSKGEKIPSAEATGFQLDTEENDNLVPGFLGSLIGIRPGETRSFPIQFPESFDQESLQGVRAQFTVVCKELFFRELPELDDSLAAKLLPGCTTMDQVRERILERCKEVEKTAIEQATDNAILDQLGKLVEVDVPRAMFQEQGQQLYGAKLLQLQAERQLNKDQLASLSSERSVQEYLKSERENITRIIKQMLAVGEIFKAENLQYSTDQLVKEVENSIEEFKRYNQDYDEGNIKQQVQDVLEAAKVLEWLKENCTIEYIRQ

SEQ ID NO: 6571 - protein, 241 aa, Leymus cinereus x Leymus triticoides
MSMAATAATAWPSTSSFVLTPRTRHHAAPSTPTRALRSGFLGRALTLCPHPVDARAAISVSAAVSVRAAWDGPLSSARLIMQGRNVKLTEKLKEHIEDKVGRAVSNHAHLVREVDVRLSARGGDLSKGPKLSRCEVTLFTRRHGVVRAEEEEESSYASIDAAAAVVKRKLRKIKEKETDVRHLKGTKEWQSSGLCPTWRTSRRLRSWRRRRTTISSRSSAPRTRRQCSPRLCAPRCSRWRR

SEQ ID NO: 6572 - protein, 307 aa, Avena sativa
MSIAATAAAAAAWPSTSSSVLAPHSHHATPRTCCHLRSGFLGRALAVAPHPATAAVSASAAVSVRAAWDGPLSSARLIMQGRNVKLTEKLKEHIEDKVGRAVSKHSHLVREVDVRLSARGGDLGRGPKASRCEITLFTRRHGVVRAEEEEESSYASIDVAAGIIKRKLRKIKEKETDVRHLMKGTKEWIDAGDALASESDVEVDEEEEEDDELVEVIGAEDEETVLTKVVRTKVFEMAPLTVDEALEQLENVDHDFYAFRNEQTGEVNILYKRKEGGFGLIIPKQDGHVDKETVAKQANGKEQSLAG

SEQ ID NO: 6573 - protein, 210 aa, Hordeum vulgare
MASGVFGTPISEKTVIATGEYKEPITQKDVADYTMKMINAGGKDVNAQKFVDNLKERYGNGIAVKCLIYNATGATLSLAKYNDWHGHIYDTPYPSDIQNGQWGAFLHVHPSGAAVGSAGAVVYRSKIPSSTRSCDWLFSWTVPYIGANGVYTEIREEGHYPSVGSWSYIYDVKLANSNLNSTDKNYGYVSKTNIGEGSTMNARGVFQFPY

SEQ ID NO: 6574 - protein, 210 aa, Hordeum vulgare
MASGVFGTPISAQTVIATGEYKEPITQKDVADYAMKMINAGGKDVNAQKFVDNLKERYGNGIAVKCLLYNATGATLNFAKYNDWHGHIYDTPYPSDIQNGQWGAFLHVHPSGAAAGSAGAVVYRSKIPSSSSSCDWLFSWTVPYIGGNGVYTEIREEGHYPSVGSWDYIYNVKLKNSSVTSIDSNYGYVSKADIGEGTTMNARGVFEFPY

SEQ ID NO: 6575 - protein, 207 aa, Leymus cinereus x Leymus triticoides
MASGVFGTPISEQTVIATGEYKEPITQKDVADYAMKMINAGGKDLNAQEFVDNLKERYGNGISVKCLIYNATGTTLSLATYNNWHGHIYDTPYPSDIQNGQWGAFLHVKGGGAVGSAGAVVYRSKVPSSTSSCDWLFSWTIPYIGDNGVHTEIREEGHFPKHWDYIYNVKLANSNLSSTDKGYGYVSKLDIAEGTTINARAVFQLPY

SEQ ID NO: 6576 - protein, 819 aa, Triticum aestivum
AQALDEAALLRYAAAHVPGFPGPAPSLALTQFGHGQSNPTYCIQASAPGGEARRYVLRKKPAGAILQSAHAVEREFQVLKALGAYTDVPVPKVFCLCTDASVIGTPFYIMEYLEGALYLNNKLTGITPDKRRNIYLAAAKTLAAIHKIDATAVGLQKYGKRDNYCKRQVDRWGKQYLHSTGEGKPARYQKMLDLIDWLKENIPEEDSSTGLGTGLVHGDYRVDNLVFHPTEDRVIGVLDWELSTLGNQMCDVAYSCMPYIIDATLSENSSYGGFEHSGIPDGIPQLEEYLAVYCSMSARPWPAANWKFYIAFSLFRGASIYAGVYHRWTMGNASGGERARFAGKAANVMVDCAWHYINRENVLRAHPATGMHVLKAPRQGFHVEQEDSTLTNGQGKFVPSEKVMQLRQKIMKFMKDHIYPKEDELYKHAQSTSRWTIHPEEENLKALAKEEGLWNLFIPLDSAARARKLLLEDQSHVSAGSSNDLLLGAGLTNLEYGYLCEIMGRSVWAPQIFNCGAPDTGNMEVLLRYGTKEQQKQWLVPLLEGKIRSGFAMTEPQVASSDATNIECAVSRQGDFYVINGRKWWTSGAMDPRCKILILMGKTDFSAPRHKQQSMILVDINTPGVQIKRPLLVFGFDDAPHGHAEITFDNVRVPVTNILLGEGRGFEIAQGRLGPGRLHHCMRLIGAAERGMNMMVERALSRTAFGKKIAQHGSFQSDLAKCRIELEQTRLLVLEAADQLDRHGNKKARGILAMAKVAAPNMALKVLDMAIQVHGAAGVSSDTVLSHLWATARTLRLADGPDEVHLGTIAKLELQRARM

SEQ ID NO: 6577 - protein, 838 aa, Brachypodium distachyon
MAAGARRTRELLRPVDAAQALDEAALLRYAAAHVPGFPSPAPSLALSQFGHGQSNPTYCLEVSVPGGGGETRRYVLRKKPPGAILQSAHAVEREFQVLKALGAYSDVPAPKVFCLCTDASVIGTPFYIMEYLEGILYLDTKLPETTPSKRKAIYFAAAKTLAAIHKVDVAAVGLQKYGRRDNYCKRQVDRWERQYLHSTGEGKPARYPKMLDLVRWLKENVPEEDSSTGLGTGLVHGDYRVDNLVFHPTEDRVIGVLDWELSTLGNQMCDVAYSCMQYIIDSTPTENSSYGGFERSGIPDGIPQLEEYLAVYCSMSARPWPVANWKFYIAFSLFRGASIYAGVYHRWTMGNASGGERARFAGKAGNAMVDCAWNYINRENVLREQPATGMLVSKAPRQEFHREQEGSTSTNGQGRFVPSEKVMQLREKIMKFMKDHIYPKEDELYKHAQSTSRWTIHPEEENLKALAKEEGLWNLFIPLDSAARARELLLEDRSHISPGSSDDLLLGAGLTNLEYGYLCEIMGRSVWAPQIFNCGAPDTGNMEVLLRYGTKEQQKQWLVPLLEGKIRSGFAMTEPQVASSDATNIECAISRQGDFYVINGKKWWTSGAMDPRCKILILMGKTDFSAPKHKQQSMILVDINTPGVQIRRPLLVFGFDDAPHGHAEITFDNVRVPVNNILLGEGRGFEIAQGRLGPGRLHHCMRLIGAAERGMNMMVERALSRTAFGKRIAQHGSFQSDLAKCRIELEQARLLVLEAADQLDRHGNKKARGILAMAKVAAPNMALKVLDMAMQVHGAAGVSSDTVLSHLWATARTLRIADGPDEVHLGTIAKLELQRARL

SEQ ID NO: 6578 - protein, 836 aa, Sorghum bicolor
MAKLTSELLRPVDPAAALDEAALLRYLAANVPGFPGPAPALSLTQFGHGQSNPTYCIHAYASAPGGGPARRYVLRKKPPGSILQSAHAVEREYQVLKALGDHTDVPVPKVYCLCTDASVIGTPFYVMEYLEGIIYPDSALPGVTPSKRRAIYFYTAKTLAAIHKVDVDAIGLQKYGRRDNYCKRQVQRWERQYLASTGEGKPARYQRMLDLARWLKEHVPKEDSSAGSGTGLVHGDYRPDNLVFHPTEDRVIGVIDWELSTLGNQMCDVAYSCLPYIIDASISERTSYGGFQDNGIPDGIPQLEEYLSVYCSFSARPWPAANWKFYIAFSLFRGASIYAGVYHRWTMGNASGGERAKFAGKVANAMVDCAWDFINRVNVLQEPPSKGFQVSPAPWQEFHREEESSTSEKNQGKFVPSEKVMQLRKKLIKFIEDHIYPMEGEFYKHAQSTSRWTIHPEEENLKALAKKEGLWNLFIPLDSAARARKLLLEDHSQISLGSSNDILLGAGLTNLEYGYLCEIMGRSVCAPQIFNCGAPDTGNMEVLLRYGTKEQQKQWLVPLLEGTIRSGFAMTEPQVASSDATNIECSISRQGDFYVINGRKWWTSGAMDPRCKILILMGKTDFSAPKHKQQSMILVDINTPGVQIKRPLLVFGFDDAPHGHAEITFENVRVPVTNILLGEGRGFEIAQGRLGPGRLHHCMRLVGAAERGMDLMVERALSRTAFGKRIAQHGSFLSDLAKCRIELEQARLLVLEAADQLDRHGNKKARGILAMAKVAAPNMALKVLDMAMQVHGAAGVSSDTVLSHLWATARTLRIADGPDEVHLGTIAKLELQRARL

SEQ ID NO: 6579 - protein, 834 aa, Zea mays
MTKLTSELLRPVVPAAALDEAALLRYLVANVPGFPGPAPALSLTQFGHGQSNPTYCIHASAPGGGQPRRYVLRKKPPGAILQSAHAVEREYQVLKALGDHTDVPVPKVYCLCTDASVIGTPFYIMEYLEGIIYPDSALPGVTPSKRRAIYLSTAKTLAAIHKVDINAIGLQKYGRRDNYCKRQVERWERQYLASTGEGKPARYQRMLDLARWLKEHVPEEDSSPGPGTGLVHGDYRPDNLVFHPTEDRVIGVIDWELSTLGNQMCDVAYSCLPYIIDAAPSARTSYGGFQDTGIPDGIPQLEEYLSIYCSFAARPWPAANWKFYIAFSLFRGASIYAGVYHRWTMGNASGGERAKFAGRVANAMIDCAWDFINRVNVLQELPSKGSQVLGASWQEFHREEESSTSEKNQGKFVPSEKVMQLRKKLIKFIEDHIYPMEAEFYKHAQSTSRWTIHPEEENLKALAKKEGLWNLFIPLDSAARARKLLFEDHSQISLGSSNNLLLGAGLTNLEYGYLCEIMGRSVWAPQIFNCGAPDTGNMEVLLRYGTKEQQKQWLVPLLEGTIRSGFAMTEPQVASSDATNIECSISRQGDFYVINGRKWWTSGAMDPRCKILILMGKTDFSAPKHKQQSMILVDINTPGVQIKRPLLVFGFDDAPHGHAEITFENVRVPVTNILLGEGRGFEIAQGRLGPGRLHHCMRLVGAAERGMNLMVERALNRTAFGKRIAQHGSFLSDLAKCRIELEQARLLVLEAADQLDRHGNKKARGILAMAKVAAPNMALKVLDMAMQVHGAAGVSSDTVLSHLWATARTLRIADGPDEVHLGTIAKLELRRSRL

SEQ ID NO: 6580 - protein, 831 aa, Oryza sativa
MLTSGLLRPVDDAHAIDEAALLRYAAEHVAGFPSPARGLALTQFGHGQSNPTYCIEASAPGGVTARYVLRKKPPGAILQSAHAVEREFQVLKALGTYTDVPVPKVFCLCTDASVIGTPFYIMEHLEGLIYPDNKLTGVTPTKRKTIYLAAAETLAAIHKVDVTAIGLQKYGRRDNYCKRQVERWGRQYLSSTGEGKPARYQKMLDLAHWLKEHIPKEDSSAGFGTGLVHGDYRVDNLVFHPTEDRVIGVLDWELSTLGNQMCDVAYSSLPYIIDATTSTGYSYGGFEYTGIPDGIPPLEEYLAAYCSISARPWPAASWKFYVAFSLFRGASIYAGVYHRWTMGNASGGERARFSGKIANAMVDRAWDIINRENVLREQPARGMHASNGPSQEFQRKHEGSISTKDQGKFVPSEKVMQLRNKLMKFMEDYIYPMESEFYKRAHSTSRWTIHPEEEKLKALAKREGLWNLFIPLDSAARARELLFEDMSHGSPGSSEELLLGAGLTNLEYGYLCEIMGRSIWAPQIFNCGPPDTGNMEVLLRYGTKEQQKQWLVPLLEGKIRSGFAMTEPQVASSDATNIECSISRQGDFYVINGTKWWTSGAMDPRCQILVLMGKTDFSAPKHKQQSMILVDVKTPGVQIRRPLLVFGFDDAPHGHAEITFENVRVPATNILLGEGRGFEIAQGRLGPGRLHHCMRLIGAAERGMNLMVERALSRTTFGKKIAQHGSFLADLAKCRVELEQARLLVLEAADQLDRHGNKKARGILAMAKVAAPNMALKVLDMAMQVHGGAGLSSDTVLSHLWATARTLRIADGPDEVHLGTIAKLELQRARM

SEQ ID NO: 6581 - protein, 738 aa, Triticum aestivum
HASARDVPVPKVFCLCTDASVIGTPFYIMEYLEGALYLNNKLTGITPDKRRNIYLAAAKTLAAIHKIDATAVGLQKYGKRDNYCKRQVDRWGKQYLHSTGEGKPARYQKMLDLIDWLKENIPEEDSSTGLGTGLVHGDYRVDNLVFHPTEDRVIGVLDWQLSTLGNQMCDVAYSCMPYIIDATLSENSSYGGFEHSGIPDGIPQLEEYLAVYCSMSARPWPAANWKFYIAFSLFRGASIYAGVYHRWTMGNASGGERARFAGKAANVMVDCAWHYINRENVLRAHPATGMHVLKAPRQGFHVEQEDSTLTNGQGKFVPSEKVMQLRQKIMKFMKDHIYPKEDELYKHAQSTSRWTIHPEEENLKALAKEEGLWNLFIPLDSAARARKLLLEDQSHVSAGSSNDLLLGAGLTNLEYGYLCEIMGRSVWAPQIFNCGAPDTGNMEVLLRYGTKEQQKQWLVPLLEGKIRSGFAMTEPQVASSDATNIECAVSRQGDFYVINGRKWWTSGAMDPRCKILILMGKTDFSAPRHKQQSMILVDINTPGVQIKRPLLVFGFDDAPHGHAEITFDNVRVPVTNILLGEGRGFEIAQGRLGPGRLHHCMRLIGAAERGMNMMVERALSRTAFGKKIAQHGSFQSDLAKCRIELEQTRLLVLEAADQLDRHGNKKARGILAMAKVAAPNMALKVLDMAIQVHGAAGVSSDTALSHLWATARTLRLADGPDEVHLGTIAKLELQRARL

SEQ ID NO: 6582 - protein, 804 aa, Panicum virgatum
NVPGFPGPAPALALTQFGHGQSNPTYCIQASAPGGGTRRYVLRKKPPGVILQSAHAVEREYQVLKALGSHTDVPVPKVYCLCTDANVIGTPFYIMEYMEGIIYPDSMLPGVAPSKRRAIYFSTAKTLAAIHRVDVNAIGLQKYGRRDNYCKRQVERWEKQYLASTGEGKPARYQRMLDLARWLKENVPEEDSSAGAGTGLVHGDFRADNLVFHPTEDRVIGVIDWELSTLGNQMCDVAYSCLPYIIDATLSERTSYGGFQHTGIPDGIPQLEEYLSVYCSFSARPWPAANWKFYVAFSLFRGASIYAGVYHRWTMGNASGGERAKFAGRIANTMVDCACDFINREHVLQEQPSMGFQVSAALWQEFGREQEGSISTKDQGKFVPSEKVMHLRKKLMKFIEDHIYPMESEFYKLAQSTSKWTIHPEEETLKALAKKEGLWNLFIPLDSAARARKLLFEDGSLVSPGSSNDLLLGAGLTNLEYGYLCEIMGRSVWAPQIFNCAAPDTGNMEVLLRYGTKEQQKQWLVPLLEGKIRSGFAMTEPQVASSDATNIECSISRQGDFYVINGRKWWTSGAMDPRCKILILMGKTDFSASKHKQQSMILVDINTPGVQIKRPLLVFGFDDAPHGHAEIVFENVRVPVTNILLGEGRGFEIAQGRLGPGRLHHCMRLIGAAERGMGLMVERALSRTAFGKRIAQHGSFLSDLAKCRIELEQARLLVLEAADQLDRHGNKKARGILAMAKVAAPNMALKVLDMAMQVHGAAGVSTDTVLSHLWATARTLRIADGPDEVHLGTIAKLELQRARL

SEQ ID NO: 6583 - protein, 521 aa, Triticum aestivum
MATPPEANTSPAPNGGGCGGIRVENCYVFKSRLQEYAQKAGLMTPEYQTLKEGPSHEPIFKSSVVINNVKYDSLPGFFSRKAAEQSAAEVALMEIGKSVALPTNATIPAVQETGLCKNLLQEYAQKMNYAIPSYICNKQGPYICTVEIGGIQYIGATARTKKEAEIKAARTALLAIQGQSEGCANGTTKYIVVPGKRQGKEIEKKPVETPKSLKTKKGGFKKQRNKNKFIKKNGQVNEEKDETGVPGDAHHSDVPMKPAVTTEDPLTNTEMIQPDEAWPFEHEPTGDTAMLQPDEDAWPSKHEPTGDTAMLQPDGEATKVEQEQLSDTAMLQPDDEGGRVEHEQLSNAPMVLHNEEARNVKQEALIGTAMPQPHVEDRRVGAEPPRDAAMVQSNDEARCVKQELLIDAAMPLPNEEAGAAANPVPLSDSITAQPNAETTNINESLRNAASAQHNEEARTVNQEPPSSASLLQPKEPRVEIGEFVSENKDQTLGDASREANRSIEDMPEKCSDNSSAFTSVE

SEQ ID NO: 6584 - protein, 283 aa, Triticum aestivum
MEAEYPQINPLLLCSRRRKREEDEGGLELLLSMDLDEEETRSEQQAPPRVPDKLKAVSQELGHDIRIFTSTTFELMTSKLSKADQEEDDDFYELQPSDYYKLISNRLAEQSKVLKTRKIREAELAAQRARLTKAVARVRFPDGYILEAEFHPSETVHSLVDLLMKVIARPDLPFYLYTVPPKKRIMDTSQDFYTIGFVPGANVFFSYDLPEGSELNTDAVKSGPYLREEIRTLDGLSLQSEPSDQPDDSKTNSDSAHQSYAFQSDSAPAAANKKSAKPKWFKR

SEQ ID NO: 6585 - protein, 278 aa, Leymus cinereus x Leymus triticoides
  misc_feature (7)..(7): Xaa can be any naturally occurring amino acid
  misc_feature (16)..(16): Xaa can be any naturally occurring amino acid
PQINPLXLCSRRRKRXEDEGGLELLLSMDLDEEETRSEQQAAPRVPDKLKAVGQELGHEIRIFSSTTYESMTSKLPRADQEEDDDFYELQPGDYYKLISNRLAEQSKVLKTRKIREAELAAQRARITKAVMRVRFPDGYILEAEFHPSETVHSLVDLLMKVIARPDLPFYLYTVPPKKRILDTSQDFYTIGFVPGANVFFSYDLPEGSELNTDGVKFGPYLREEIRTLDGLSLQSEPSDQPDDSKTNSDSAHQSEAFRPDSAPPAANKKSAKPKWFKR

SEQ ID NO: 6586 - protein, 254 aa, Triticum aestivum
PMEAEYPQINPLLLCSRRRKREEDEGGLELLLSMDLDEEETRSEQQAPPRVPDKLKAVSQELGHDIRIFTSTTFELMTSKLSKADQEEDDDFYELQPSDYYKLISNRLAEQSKVLKTRKIREAELAAQRARLTKAVARVRFPDGYILEAEFHPSETVHSLVDLLMKVIARPDLPFYLYTVPPKKRIMDTSQDFYTIGFVPGANVFFSYDLPEGSELNTDAVKSGPYLREEIRTLDGLSLQSEPSDQPDDSKDKF

SEQ ID NO: 6587 - protein, 279 aa, Avena sativa
EYTQINPPLPLCPRRRKREDEEGLALLLSMDLDTDETRPPQQAAAPVPAKLKAVAQELGHEIRIFSSTTFESITSSLPKADQEEDDDFYEFQPADYYKLFSNRMAEQSKVLKTRKIREAELAAQRARITKAVMRVRFPDGYILEAEFHPSETVHSLVDLLMKVIARPDLPFYLYTVPPKKRILDTSQDFYTIGFVPGANIFFSYDLPAGSVLNTDGVISGPYLCEEIRALDGMSLLSEPSVQPDDSKTNADSAYQSDAPRSNPAPPENKKSGKPKWFKR

SEQ ID NO: 6588 - protein, 247 aa, Pseudoroegneria spicata
GLELLLSMDLDEEETRPEQQAAPRVPDKLKAVSQELGHEIRIFSSTTFELMTSKLPRADQEEDDDFYELQPGDYYKLISNRLAEQSKVLKTRKIREAELAAQRARITKAVMRVRFPDGYILEAEFHPSETVHSLVDLLMKVIARPDLPFYLYTVPPKKRILDTSQDFYTIGFVPGANVFFSYDLPEGSELNTDAVKFGQYLREEIRTLDGLSLQSEPSDQPDDSKAKSDSAHQSYAFQSDSAPAAAA

SEQ ID NO: 6589 - protein, 1012 aa, Triticum aestivum
MASKFGLAGGIPERRVRPIWDAVDSRQYKSALKLCTALLAKHPTSPYALALKALTLERMGKPDEALSVCLEAKELLYSNNIFHFDDLTLSTLQIVFQRLERLDLATSCYEYACTKYPNNLELMMGLFNCYVREYSYVKQQQTALRMYKTVGEERFLLWAVCSIQLQAYFSSGGEKLLAFAEALLKKHISSHSLHEPEALSLYVSILEQQAKYDAALEVLSGDLGSLMGREEDKLRLQGRLLTQACNYVAASEIYQKVLESCPDDWESFLHYLGCLLERDVELPKPTTGEHTCSSCSVDLNKTSLSEEVVESRLASALLFVQKLQKNDSSDCVRGPHLANIEIERQHRLSGNSTKFMEALVNYFHRFGHLSCSSSDVEIYLHMLSGDEITELLDTISRSFDASSVSVKALGLTITAFKVQELLGTLLSKSTTDLQCIAKGMVETFYKNLPLSRDLDPQESMHGEELLSMASNILVQLFWRTRNLGYLLEAVLVLEFGLTVRKHVWQYKITLVHLYSYLGALPLAHRWYVSLEVKNILLESVSHHILPQMLSSPFLQQTASLVKDYLRFMDDHLKESADLTCLAYRHRTYSKVIEFVQFKNRLQRSMQYLAVKSDSVILSLKQKSESLDEVESVLENVNHGGGLVDLSSEDNMKHLTFNEDLEARPWWTPTTSVNFLSEPIDESSTPACFRAKVCKHKSTEKDGPKMRDAERKCLVPRLVYLSMHGCVSSLRETEPNGSVSDITVGEMKTLLEKYARTIGYSMDDALSMILGISSGKKSMKDFAPDIVSWMSFAVFINAMNLWSNESVIPRTDPSSPSSWEIVDSLVKICIEEHLTDANRILTCPGNKIPLLVQMVTEPISWHLIIIQSCMRVVAPQGKKKKKSGPSVRPNMPQLQGIQRSVQCLIETLRSVQKWLSDQMSPEEQGLDILMSYLQGTGDEGPGQTFRVLEEKPIAHASELGDRIAQSLEAWSSTGVVRRIVGAEHEVLAEFKKMVDSKLKLLMSESASLSSMLH

SEQ ID NO: 6590 - protein, 1014 aa, Brachypodium distachyon
MSSKFGLAGGIPERRVRPIWDAVDSRQYKAALKLCTALLTKHPTSPYALALKALILERMGKPDEALSVCLNAKELLHSNNIFHFDDLTLSTLQIVFQRLERLDLATSCYEYACTKYPNNLELMMGLFNCYVREYSYVKQQQTAIRMYKTVGEERFLLWAVCSIQLQFYFSSGGEKLLALAEALLKKHISSHSLHEPEALAIYISILEQQAKYDAALEVLSGDLGSLMGREEDKLRLQGRLLTQACNYVAASEIYQKVLESCPDDWESFLHYLGCLLELDVNMPKPTTGGHTCSSCSVDSTMLNKTSLSEEVVESRLASALSFVQKLQKNESGDCVRGPHLANIEIQRQRRLSGNTIDRKFIEALVNYFHRFGHLSCSSSDVEIYLHMLSSDEITELLDTISRSFDASSVSVKALGLTITTFKVQELLGILLSKSTTDLQRIAKGMVETFYKNLPLSRDLDPQESMHGEELLSMASSILVQLFWRTRNLGYLLEAVLVLEFGLTVRKHVWQYKITLVHLYSYLGALPLAHRRYASLEVKNILLESISHHILPQMLSSPFLQQTANLVKDYLKFIDDHLKESADLTCLAYRHRTYSKVIEFVQFKNRLQRSMQYLCVKSDSVILSLKQKSESLEEVESVLENLNHLVYLSNEDNMKHLTFNEDLEARPWWTPTTSVNFLSEPIDEVSTPVCFRAKVCKHKSTEKDGPKMRDTERKSLVPRLIYLSMHGCVSSLGETELNGAVSDITIGEMKTLLEKYARSIGYSIDDALSMILGMSSGKKSIKDFAPDIVSWMSFAVFINAMNFWSNESLIPRTDQSGPSSWQIVDSLVKICVEEQLTEANRILTCPGNNIPVLVQMVTEPISWHLIMIQSCMRAMAPQGKKKKKSGPAERSNIPQLQGIQRSVQCLINTVQSIQIWLSDQMCPEEQALDTLLSYLPAASDEGPGQMLRVLEDNPAAHHSELGDRIAQSLKTWNCTDALRRIVGAEHELLAEFKKTCDSKLKLLTSEAASLSSVLH

SEQ ID NO: 6591 - protein, 1016 aa, Oryza sativa
MASKFGLAGGIPERRVRPIWDAVDSRQYKAALKLCTALLAKHPTSPYVLALKGLILERMGKPDEALSVCLNAKEQLYSDNIFHFDDLTLSTLQIVFQRLERLDLATSCYEYACTKYPNNLELMMGLFNCYVREYSYVKQQHTAIKMYKTVGEERFLLWAICSIQLQVHFSIGGEKLLPLAEALLKKHITSHSLHEPEALALYISILEQQSKYDAALEVLSGDLGSLMGREEDKLRLQGRLLAQACNYTAASEIYQKILESCPDDWESFLHYLGCLLEHDVNLPKSRTSEHPSSLPVDSALALKTSLSDELVESRLASALSFVQKLQVNDTSDCVRGPHLASIEIERQRCRSGNPTDRKFIEALINYFHRFGHLSCAASDVEIYLHMLSSDETTELLDTISRSFDASSLSVKGLGLAITTFKVQELLGTFFSKSTTELQHIAKGMVEAFYKNLPLSRDLDPQESMHGEELLCMASSILVQLFWRTRNLGYLIEAILVLEFGLTVRKYVWQYKVMLVHLYSYLGALPLAHRWYVTLEVKNILLESASHHILPQMLNSPLLQQTADLVKDYLKFMDDHLKESADLTCLAYRHRTYSKVIEFVQFKERLQHSMQYLSVRSDSIILSLKQKAESLDEVESILENVNHGARLVELSNEDNVKRFTFNEDLQARPWWTPTTSVNFLSEPFDEGSTPACFRAKACEHKSTEKDDSKIKYAERKALLPRLVYLSMHGCASSLRETQLNGSGLDTDATEMKPLLLKYARSIGYSIDDALSVILGMSSGKKSVKDFTPDIVSWMSFAVFINAWNLWSNESVVPRADESSPSSWQIVDSLVKICVEEQLIDANRILTSPGNNIPVLVQMITEPISWHLVVIQSCVRSMAPQGKKKKKGGPSERPNVPRLQAIQRSVQCMIDTLRSVQSWLSDQMRPEEQALDILLSYLQGGNEDGPGQISCILEENSARHNPELGERIAQSLETWSSAGVVRRIVGAEKELLVELKKICDSKLKLLASVSASLSSALH

SEQ ID NO: 6592 - protein, 116 aa, Triticum aestivum
MQTAKVKVKDAVSSAKEKAKEGTAKAQGKTGKATATTHGEKEMAKEETRANKAQAKAEMHQEKAEHRAEAAAGRHGATHVPLTGPHGHHRPVGAAPAAADPAYPGTGAYPTTDKYV

SEQ ID NO: 6593 - protein, 116 aa, Pseudoroegneria spicata
MQTAKVKVKDAVSSAREKAKEGTAKAQGKTGKATATTHGEKEMAKEETRANKAQAKAEMHHEKAEHRAEAAAGRHGATHVPLTGPHGHHRPAGAAPAAADPAYPGTGAYPTTDKYV

SEQ ID NO: 6594 - protein, 110 aa, Triticum aestivum
MQTAKVKVKDAVSSAKEKAKEGTAKAQGKTGKATATTHGEKEMAKEETRANEAQAKAEMHQEKAEHRAEAAAGRHGATHVPLTGPHGHHRPAGAAADPAYTGTGAYPTTD

SEQ ID NO: 6595 - protein, 120 aa, Triticum aestivum
MQTAKVKMKDAVSSAKEKAKEGTAKAQGKTGKATATTHGEKEMAKEETRANKSQAKAEMHQEKAEHRAEAAAGRHGATHVPLTGPHGHHRPVGAGAGAAPAAADPAYPGTGAYPTTDKYV

SEQ ID NO: 6596 - protein, 597 aa, Triticum aestivum
EDAGDAGGGRSTARKLVPWSSWAEWRFVRDAIFSPYPDPGAALRRIAAWRSRGCLPIPVEVTAALFEIRLRDPFFRNGVASDDKLESDEMLALLYSMAIIRLVNGFMESPHKETGRSISDLAETVGVPRILVDIRHESSHRGIPSLRLLHLAAIKAFDWLKCNYWDSQTSAIPDVRLELNSVLHDIAQSLKGKDSENAKSGSKRKRSQKHILNAIRYVRRLYYTCPSEAVSVLLEFCQLDAPEISENSDVHQSDSLDVNHSSDVQIQNQISNGDMKTIITKLSEKEPRVLLGLLKSVIEMIEARNDLEHKGGSYVCLPAESSTMKNLCSLVLWIVTSIKELKDSGRIGLVHEIGVLSSDRNAVPRFCLAKLLQKLLSLPAIGERCIADAALLLIEMAGNNNVKEKLRKLPLLSLRRSPKDCTLLESRILPNGQESVESATQKLEAFKLQLRKTDNASLAENGTEGTLNTSMPEKRNRWSIAKSWTPCPLGMIPCSYSSTAVLPVLDVIDDELKHDTAEHENFEPDGQIEIFDCYSQPEQQLDGEGILEISRLPPEHGISDMPESTFGLRGTLLVGGVWKKVTEEELLSIKSSMKILL

SEQ ID NO: 6597 - protein, 609 aa, Triticum aestivum
  misc_feature (263)..(263): Xaa can be any naturally occurring amino acid
  misc_feature (388)..(388): Xaa can be any naturally occurring amino acid
  misc_feature (393)..(393): Xaa can be any naturally occurring amino acid
  misc_feature (410)..(410): Xaa can be any naturally occurring amino acid
  misc_feature (415)..(415): Xaa can be any naturally occurring amino acid
WTRRSSSAPMEAAEDAGDAGGGRSTARKLVPWSSWAEWRFVRDAIFSPYPDPGAALRRIAAWRSRGCLPIPVEVTAALFEIRLRDPFFRNGVASDDKLESDEMLALLYSMAIIRLVNGFMESPHKETGRSISDLAETVGVPRILVDIRHESSHRGIPSLRLLHLAAIKAFDWLKCNYWDSQTSAIPDVRLELNSVLHDIAQSLKGKDSENAKSGSKRKRSQKHILNAIRYVRRLYYTCPSEAVSVLLEFCQLDAPEISENSDXHQSDSLDVNHSSDVQIQNQISNGDMKTIITKLSEKEPRVLLGLLKSVIEMIEARNDLEHKGGSYVCLPAESSTMKNLCSLVLWIVTSIKELKDSGRIGLVHEIGVLSSDRNAVPRFCLAKLLQKXLSLPXIGERCIADAALLLIEMXGNNNXKEKLRKLPLLSLRRSPKDTLLESRILSNGQESVESATQKLEAFKLQLRKPDNASLAENGTEGTLNTSMPEKRNRWSIAKSWTPCPLGMIPCSYSSTAVLPVLDVIDDELKHDTAEHGSFEPDGQIEIFDSYSYPEQQLDGEGILEISRSPPEHGISDMPEMASGLRGTLLVGGVWKKLTEEELLSIKSSMKILL

SEQ ID NO: 6598 - protein, 540 aa, Brachypodium distachyon
MTATTAAAEVDAEVRGILERVAADSFPPLHAVHHLLSVGVCVPCTFRMFGAFSHVCSCTSLTASVLHSFLEDHDDSAKGGPCSCLSTDEACCSVCFGVLLPTCHQDDGVVSFNGISPIDRITSMVFQAVQRESYQLDEFFLEISLPAVVAANERAIRLHMKEKYGNENWFKDKIFSQQTMSVKEALRLLLVPSLEKKLDVKHGNNSFRIRLTYTHDDASRKLKSLLPNDRNRKRKTESREGTDTRRNSTYEDNQILSETDSFIHKTLECIQDQEFCSLFQLPPEKVFKPCHLVISCLRSPIYIGGRYLKLSRNVSQSCWIIDDERMGEASVEEIIGEDVRTICRGDGCKFHAAGREDIDVRMLGSGRPFLIEVLNARSIPSAIEVEQIAEKINSSEKKYVRVRNLKLVDREIWSMMREGEAEKQKQYAALIWTSRSLTDVDLQKISGVNDMEIVQNTPIRVLHRRSPLERKRIIHWMEIEKVEGSSNYYLLHLCTQAGTYIKEFVHGDLGRTHPSIGAILGCRAEILQLDVTDVKMDLLQ

SEQ ID NO: 6599 - protein, 461 aa, Triticum aestivum
MPPSREQPAAAAADGGVEENVMAILDSFVGIKDSRDLHDDRAAFLEAVRSVCLAGDKPSTPTERMYDAVFQIFQSSSSLELTIASFHLLMELGKQYPRVYLTNSGSHPTLVIVKESWSPFLLGNNVASGELGRNTSRSDHLFDSLRFSLLTEAMVEASNDTGANNGLKHIENMVLFQYLVRTLEADFVPRHIAYKESLDWVIIRESVLSVLLGSRKLVFKMFVKNCISLLNQHQREVEDDISSKSASDLDSSLTFSLLEFEREALISVKKLFIMVINLDLIRKEADKLGLTSRADGLRNPILEVILEELTYNTIYLSPFLLAFTEWKWKLQIILQYFSRYQVKSAVRTRRSDNSQQDLTVESALSMFSTEASAKAMVKMMCPEVAQLLLAHAYQVCLSVDGDSSEANDAAKMMGASLLEISCKFVLAFQNLRKINTNIQISQFEKEALFTAATLTRKLQNE

SEQ ID NO: 6600 - protein, 1088 aa, Oryza sativa
MEVDPPPPPPPPMANYFDPESSGRREEYRRYRKRLSSSNASPLLGTAVSKFSEARLFCDGNSIQRRPNAGLLLEDIKQEAADISDFDSLDESKLFGSGKKRASLDASDAGFSSGRQAVRSALKSVKLEEDMPHEGETTSTIFASLLDSAIQGLMPFSDVILQFERTCRNASESIRSAGTGKLRMVEDRLMQQKAQLLLDEAASWSLLWYLYGKGNEELPGELFVAPTTSHQEACRFVVTDLTAQLCLRIVLWLEGLASEALDLEKKVRGSHVGSYLPSSGVWHRTQRYIKRKNNDTTIVKHVDFDAPTREGAQLLPDDKKQDELLLEDIWTLLRAGRLEEASELCRSAGQSWRAATLCPFGGIDLFPSLEAMLKNGKSRTLQAIELESGVGRQLCLWKWASYCASEKIAEQDGGRYEMAVYALQCSNLKRILPICTDWESACWAMTKSWLGVQVDLVLSQYQTSRPEEKQFDDEMNGTQPMLNSAGPESWPHSVLDQQPRDISALLQKLHSSDLVHETVSRACREQHRQIEMNLMSGNIAHLLDLLWSWVSPSEDDQNILRPRDDPDMIRFGAHIVLVLRYLFSDEMEDEFEEKLVAVGDLIINMYVRYLFSEQQEELVGVYASQLERDLCIELFVEMMELRLNSSLHTMFKLFLSAVEYLPFSSGDASKASLEEIIERVLSRSREPKPIKYDEDIFDVAEMHHLQALQKATVIQWLCFTPPSSIPDFQMISGKLLIRALMHSNTLFREFSLISMRRVPELPVGPHKLLAILAEPLKQKENLISLEDPEVSDNLREFEDWHEYYSLDATYRSWLKFEMENASISPEMLSAEEKSQAVAAAKETLELAFLLLYREDIPWLNAVESSPIEPSEHVFLELHATAILCLPSGECMLPDATSCTALTSALYSTVSETEVLHRQLKVDVNVSSKDPCCIQVSLLCLAVEGDGLGLHEANDGGLLAAIMAAGFKGELNRFQPGVSIEISRLDAWYSDGHGSVESTAAYIIRGLCRRCCLPETILRSMQASIALSEAGDSLDHCDKLIELVASSESGIMHLFSQQQLQEFLLFERECYLSKMELEEEQLEQLPADG

SEQ ID NO: 6601 - protein, 1097 aa, Sorghum bicolor
MEVDPSPSPRSSRPLPPPPLAPTPSYFDPESSGRREEYRRYRKRLSSSNVSPLPGSSLSKSSGPRLLYDGESIPRRPNAGLLLEDIKQEAADYSNMESLDGSILYSSAKRTSLDGGSASAAAYSSGRQAVRQALKPVKLEDDIYVPHEGETSFTMFATLLDSANQGLMPVPDVIQQFERTCRNASESIRSAATGKLRMVDDKLMQQKAQLLLDEAASWSLLWHLYGKGHEELSGELLVPPITSHQEACRFVAADLTAQLCLRIILWLEGLASEALDLEKKVRGPHVGSYLPSSGVWHRTQRYLKRNNNDSTIVKHVDFDAPTREGAQLLPDDKKQDELLLEDIWTLLRAGRLEEASELCRSAGQAWRAATLCPFGGIDMFPSLDALHKNGKYRTLQAIELESGVGRQWRLWKWASYCASEKIAEQDGGRYEMAVYALQCSNLKRILPICTDWESACWAMARSWLDVQVDLELSQYQTSRPDEKQLDDDMNGAQSSVGPESWPYHVLDQQPRDLTALLQKLHSSDLVHETVSRACREQHRQIQMNLMSGHISHLLDLLWSWLSPAEENHSNTARPLDDPEMIRFGAHIVLVLRHLFSDEMDDELDEKLVTVGDLIINMYVRYLFSEDQEELVGVYASQLQHDLCINLFVEMMELRLNSSLHTMYKLFLSAVEYLPFSSDDASKACFEEIIERVLSRSRQTKPSKYDEDFSDVAHQHHLQSLQKAMVIQWLCFTPPSSIPDFQMITGKLLIRALVHSNTLFREFSLISMRRVPELPAGPHKLLAILAEPLKQKENLISLEDPEVSDNLLEFEDWHEYYSLDATYRSWLKIEMKNAAVSPEMLSAEEKDQAVAAAKETLDLAFLLLCRDERPWLYAVESSPFESSEVIFLELHASAMLCLPSGECMLPDATSCTALTSALYSTVSEDDVLHRQLKVDVQVSSRDPCCIEVALRCLAAEGDGYGLHEANNGGLLAAVMAAGFKGELSRFQPGVSMAISRLDAWYSDGSGSVESTAAYIIRGLCRRCCLPETILRSMQACIALSAAGDSLDNCDKLIELVGSAESGMMHLFSQQQLQEFLIFQRECFICTMELEEDQLPSDG

SEQ ID NO: 6602 - protein, 123 aa, Triticum aestivum
MSTVEEELSECEVLWPETRHGAPGSAWGPSTAAPRASRARRQCSAPVDIPRAAHLSGGRAGLDDDEEEEEDGAMVPPHLMVSRRWSEGKAAAAFSLRSGPGRAHRDLNHLRNSVLRMTGFIEG

SEQ ID NO: 6603 - protein, 151 aa, Triticum aestivum
RKERSSSFQSRSSLITGAIRARVQNRTDMSTVEEELSECEVLWPETRHGAPGSAWGPSTAAPRASRARRQCSAPVDIPRAAHLSGGRAGLDDDEEEEEDGAMVPPHLMVSRRWSEGKAAAAFSLRSGPGRAHRDLNHLRNSVLRMTGFIEG

SEQ ID NO: 6604 - protein, 141 aa, Triticum aestivum
RASNPIPPQCKIPARAQNRTDMSTVEEELSECEVLWPETRHGAPGSAWGSSTAAPRASRDHRQCSAPVDIPRAAHLPGGRAGLDDDEEDGAMVPPHLMVSRRWSEGKAAAAFSLRSGPGRAHRDLNNLRNSVLRMTGFIEG

SEQ ID NO: 6605 - protein, 146 aa, Triticum aestivum
RKERSSSFQSKSSVLTSAIRARAQNRTNMSTVEEELSECEVLWPETRHGAPGSAWGSSTAAPRASRDHRQCSAPVDIPRGRGRAGLDDDEEEEDGAMVPPHLMVSRRWSEGKAAAAFSLRSGPGRAHRDLNNLRNSVLRMTGFIEG

SEQ ID NO: 6606 - protein, 118 aa, Triticum aestivum
MSTVEEELSECEVLWPETRHGAPGSAWGSSTAAPRASRDHRQCSAPVDIPRGRGRAGLDDDEEEEDGAMVPPHLMVSRRWSEGKAAAAFSLRSGPGRAHRDLNNLRNSVLRMTGFIEG

SEQ ID NO: 6607 - protein, 564 aa, Hordeum vulgare
HLARRLAEVGARDVFTVPGDFNLTLLDELEAEHPSGGGVRLVRCCNELNAAYAADGYARARAVGVSACAVTFTVGGLIAINAVAGALSENLPVICIVGGPNSNDYGSNRILHHTIGIPNFTQELRCFQNVTCYQALGNNLEDAHEQIDTAISTALKESKPVYISISCNLPSIPHPTFSRHPVPFFLSPKLSNQMNLEAAVETAAAFLNKSVKPVLVGGPKMRVAKACEAFVELADACGYPVAVMPSAKGLVPEHHSRFIGTYWGAVSTPFCAEIVESADAYLFAGPIFNDYSSVGYSLLLKKEKAIIVQPDRVVIGNGPAFGCVLMKDFLHALATRLKKNTAAYDNYSRIFVPQGEPLSSEHGEPLRVNVLFKHIQKMLSGSSAVIAETGDSWFNCQKLKLPEGCGYEFQMQYGSIGWSVGATLGYAQAAKDKRVISFIGDGSFQVTAQEVSTMLRWGQNNIIFLINNGGYTIEVEIHDGPYNIIKNWNYTGVVEAFHNGEGKCYTAKVRTEEELKKAIEASLGPNKDSLCFIEVIVHKDDTSKELLEWGSRVSAANSRPPNPQ

SEQ ID NO: 6608 - protein, 597 aa, Oryza sativa
MDTTIGSVPTASDAAAPAPAANSAPREATLGRHLARRLAEVGARDVFTVPGDFNLTLLDELEAEAGAGHGGVRLVGCCNELNAAYAADGYARARGGGVGACAVTFTVGGLSAINAVAGAFSENLPVVCIVGGPNSNDYGSNRILHHTIGLPDFTQELRCFQTVTCYQAVVNNLEDAHEQIDAAISTAIKESKPVYISISCNLPSIPHPTFSRHPVPFFLSPRLSNQMNLEAAVETAAAFLNKAVKPVLVGGPKMRVAKACKSFVELADACGYPVAVMPSAKGLVPEHHPRFIGTYWGAVSTPFCAEIVESADAYLFAGPIFNDYSSVGYSLLLKKEKAIIVQPDRVVIGHGPAFGCVLMKDFLHALSARLKKNTAAYENYRRIYVPPGEPPLSEPGEPLRVNVLFQHIQKMLSANSAVIAETGDSWFNCQKLKLPEGCGYEFQMQYGSIGWSVGATLGYAKAAKDKRVIACIGDGSFQVTAQEVSTMLRWGQKSIIFLINNGGYTIEVEIHDGPYNVIKNWNYTGVVEAFHNGEGKCYTAKVRTEEELKEAIEEAQGPKKDCLCFIEVIVHKDDTSKELLEWGSRVSAANSRPPNPQ

SEQ ID NO: 6609 - protein, 593 aa, Zea mays
MDTAIGSVPAASDAARHPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQAVVNNLEDAHEQIDTAISTAIKESKPVYISISCNLPSIPHPTFSRHPVPFFLSPRLSNQMNLEAAVEAAAAFLNKAVKPVLVGGPKMRVSKAWEALAELADACGYPVAVMPSAKGLVPVHHSRFIGTYWGAVSTPFCAEIVESADAYLFAGPVFNDYSSVGYSLLLKKEKAIIVQPERVVVGHGPAFGCVLMKDFLHALATRLKKNTVAYENYRRIYVPPGEPLSSEPGEPLRVNVLFKHIQAMLSGDMAVIAETGDSWFNCQKLKLPEGCGYEFQMQYGSIGWSVGATLGYAQAAKDKRVIACIGDGSFQVTAQEVSTMLRWGQNSIIFLINNGGYTIEVEIHDGPYNVIKNWNYTGLVEAFHNGEGACYTAKVRTEEELTEALEAALGPKKDCLCFIEVIVHKDDTSKALLEWGSRVSAANSRPPNPQ

SEQ ID NO: 6610 - protein, 597 aa, Brachypodium distachyon
MDAKIGSIPPPTAAASTTAAASPREATLGRHLARRLAEVGARDVFTVPGDFNLTLLDELEADGPENGVRLIGCCNELNAAYAADGYARARAGAGGVGVGACAVTFTVGGLSAINAVAGAFSENLPVVCVVGGPNSNDYGSNRILHHTIGVPDFTQELRCFQNVTCYQAVINNLEDAHEQIDTAISTAVKESKPVYISISCNLPSIPHPTFSRHPVPFFLSPRLSNQMNLEAAVEAAAAFLDKAVKPVLVGGPKMRVAKACKAFVELADACGYPVAVMPSAKGLVPEHHLRFIGTYWGAVSTPFCAEIIESADAYLFAGPIFNDYSSVGYSLLLKKEKAIFVQPDRVVIGHGPAFGCILMKDFLHALASRVNKNIAAHENYCRIFVPPGEPLSSKPGEPLRVNVLFKHVQKMLTSNSTVIPETGDSWFNCQKLKLPEGCGYEFQMQYGSIGWSVGATLGYAQAAKDKRVLAFIGDGSFQVTAQEVSTMIRWGHNTIIFLINNGGYTIEVEIHDGPYNIIKNWNYTGVVEAFHNGEGKCYTAKVRTEEELKKAIEASLGPKKDCLCFIEVIVHKDDTSKELLEWGSRVSAANSRPPNPQ

SEQ ID NO: 6611 - protein, 574 aa, Pennisetum glaucum
TDAPREATLGRHLARRLAEVGARDVFTVPGDFNLTLLDELEAEHGSTGVRLVGCCNELNAAYAADGYARARGGGVGACAVTFTVGGLSAINAVAGAFSENLPVVCIVGGPNSNDYGSNRILHHTIGLPDFTQELRCFQTVTCYQAVVNNLEDAHEQIDTAISTAIKESKPVYISISCNLPSIPHPTFSRHPVPFFLSPRLSNQMNLEAAVEAAAAFLNKAVKPVLVGGPKMRVSKACKAFVQLADACGYPVAVMPSAKGLVPEHHSRFIGTYWGAVSTPFCAEIVESADAYLFAGPIFNDYSSVGYSLLLKKEKAIMVQPERVVIGHGPAFGCVLMKDFLHALATRLKKNTAAYENYRRIYVPPGEPISSEPGEPLRVNILFKHIQAMLSGNSAIIAETGDSWFNCQKLKLPEGCGYEFQMQYGSIGWSVGATLGYAQAAKDKRVIACIGDGSFQVTAQEVSTMLRWGQNNIIFLINNGGYTIEVEIHDGPYNVIKNWNYTGLVEAFHNGEGKCYTAKVRTEEELKEAVKAALGPKKDCLCFIEVIVHKDDTSKELLEWGSRVSAANSRPPNPQ

SEQ ID NO: 6612 - protein, 591 aa, Sorghum bicolor
MDTAIGSVPASSDGAAQAASGSAPRDATLGRHLARRLAEVGARDVFTVPGDFNLTLLDELEAEEGVRLVGCCNELNAAYAADGYARARGGGVGACAVTFTVGGLSAINGVAGAFSENLPVVCIVGGPNSNDYGSNRILHHTIGLPDFTQELRCFQTVTCYQAVVNNLEDAHEQIDTAISTAIKESKPVYISISCNLPSIPHPTFSRHPVPFFLSPRLSNHMNLEAAVEAAVAFLNKAVKPVLVGGPKMRVSKACKAFVELADACGYPVAAMPSAKGLVPEHHSRFIGTYWGAVSTPFCAEIVESADAYLFAGPIFNDYSSVGYSLLIKKEKAIIVQPERVVIGHGPAFGCVLMKDFLHALATRLKKNTAAYENFRRIYVPPGEPLASEPGEPLRVNILFKHIQAMLSGNTAVIAETGDSWFNCQKLKLPEGCGYEFQMQYGSIGWAVGATLGYAQAAKDKRVIACIGDGSFQVTAQEVSTMLRWEQNTIIFLINNGGYTIEVEIHDGPYNVIKNWNYTGLVEAFHNGEGKCYTAKVRTEEELKEALKAALGPKKDCLCFIEVIVHKDDTSRELLEWGSRVSAANSRPPNPQ

SEQ ID NO: 6613 - protein, 586 aa, Saccharum officinarum
MDTAIGSVPGSSDAAASTPRDATLGRHLARRLAEVGARDVFTVPGDFNLTLLDELEAEEGVRLVGCCNELNAAYAADGYARARGGGVGACAVTFTVGGLSAINGVAGAFSENLPVVCIVGGPNSNDYGSNRILHHTIGLSDFTQELRCFQTVTCYQAVVNNLEDAHEQIDTAISTAIKESKPVYISISCNLPSIPHPTFSRHPVPFFLSPRLSNQMNLEVAVEAAVAFLNKAVKPVLVGGPKMRVSKACKAFVELADACGYPVAVMPSAKGLVPEHHSRFIGTYWGAVSTPFCAEIVESADAYLFAGPIFNDYSSVGYSLLIKKEKAVIVQPERVVIGHGPAFGCVLMKDFLHALATRLKKNTAAYENFRRIYVPPGEPLSSGPEEPLRVNILFKHIQAMLSGNTAIIAETGDSWFNCQKLKLPEGCGYEFQMQYGSIGWAVGATLGYAQAAKDKRVIACIGDGSFQVTAQEVSTMLRWGQNTIIFLINNGGYTIEVEIHDGPYNVIKNWNYTGLVEAFHNGEGKCYTAKVRTEEELKEALKAALGPKKDCLCFIEVIVHKDDTSKELLEWGSRVSAANSRPPNPQ

SEQ ID NO: 6614 - protein, 525 aa, Triticum aestivum
RLVGCCNELNAAYAADGYARARDGGVGACAVTFTVGGLSAINAVAGAFSENLPVICIVGGPNSNDYGSNRILHHTIGIPDFTQELRCFQNVTCYQAVVNNLEDAHEQIDTAISTALKESKPVYISISCNLPSIPHPTFSRHPVPFFLSPKLSNQMTLEAAVETAAAFLNKSVKPVLVGGPKMRVAKACEAFVELADACGYPVAVMPSAKGLVPEHHSRFIGTYWGAVSTPFCAEIVESADAYLFAGPIFNDYSSVGYSLLLKKEKAIIVQPDRVVIGNGPAFGCVLMKDFLHALATRLKKNTAAYDNYSRIFVPQGEPLSSEPGEPLRVNILFKHIQKMLSGSSAVIAETGDSWFNCQKLKLPEGCGYEFQMQYGSIGWAVGATLGYAQAAKGKRVISFIGDGSFQVTAQEVSTMLRWEQNNIIFLINNGGYTIEVEIHDGPYNVIKNWNYTGVVEAFHNGEGKCYTAKVRTEEELKKAIEASLGPNKDSLCFIEVIVHKDDTSKELLEWGSRVSAANSRPPNPQ

SEQ ID NO: 6615 - protein, 606 aa, Eucalyptus grandis
MDTGIGSLSSCKPPCNDVGSPPNGAAAAIQGSGPAPAVVASPDSTMGRHIAHRLVQIGVTDVFAVPGDFNLTLLDHLIAEPGLNLVGCCNELNAGYAADGYARARGVGACVVTFTVGGLSVLNAIAGAYSENLPVVCIVGGPNSNDYGTNRVLHHTIGLPDFSQELRCFQTVTCFQAVVNNLEDAHELIDTAISTALKESKPVYISISCNLPAIPHPTFSREPVPFALSPKLTNQMGLEAAVEAAAEFLNKAVKPVMVGGPKLRVAKASEAFVELADACGYAVAVMPSAKGQVPEHHPRFIGTYWGAVSTAFCAEIVESADAYIFAGPIFNDYSSVGYSLLLKKEKAIILQPERVVIGNGPAFGCVLMKDFLKALSKRVKRNTTAYENYHRIFVPDGHPLKCEPKEPLRVNVLFKHIQDMLSSESAVIAETGDSWFNCQKLKLPQGCGYEFQMQYGSIGWSVGATLGYAQAVPEKRVIACIGDGSFQVTAQDVSTMLRCGQNTIIFLINNGGYTIEVEIHDGPYNVIKNWNYTGLVEAIHNGEGKCWTTKVFYEEELIEAIQTATGPKKDSLCFIEVIVHKDDTSKELLEWGSRVSAANSRPPNPQ

SEQ ID NO: 6616 - protein, 606 aa, Eucalyptus grandis
MDTSIGALSSCKPPCNDVGSPPNGAASAIQGSAPGPAAVGSPDSTMGRHLARRLVQIGVTDVFSVPGDFNLTLLDHLIAEPGLNLVGCCNELNAGYAADGYARARGVGACVVTFTVGGLSVLNAIAGAYSENLPVVCIVGGPNSNDYGTNRVLHHTIGLPDFSQELRCFQTVTCFQAVVNNLEDAHELIDTAISTALKESKPVYISIGCNLPAIPHPTFSREPVPFALSPKLTNQMGLEAAVEAAAEFLNKAVKPVMVGGPKLRVAKACEAFVELVDACGCAVAVMPSAKGLVPEHHPHFLGTYWGAVSTAFCTEIVESADAYLFAGPIFNDYSSVGYSLLLKKEKAIILQPDRVVIGNGPAFGCVLMKDFLKALSKRVKRNTTAYENYHRIFVPEGHPLKCEPKEPLRVNVLFEHIQDMLSSESAVIAETGDSWFNCQKLKLPRGCGYEFQMQYGSIGWSVGATLGYAQAVPEKRIIACIGDGSFQVTAQDVSTMLRCGQNTIIFLINNGGYTIEVEIHDGPYNVIKNWNYTGLVEAIHNGEGKCWTAKVFYEEELIKAIKTATGPKKDCLCFIEVIVHKDDTSKELLEWGSRVSAANSRPPNPQ

SEQ ID NO: 6617 - protein, 576 aa, Silene vulgaris
YPHGPTTLLAAPEATLGRHLARRLVQIGVSDVFSVPGDFNLTLLDHLLAEPGLNLVGCCNELNAGYAADGYARSRGVGACVVTFTVGGLSVLNAIAGAYSENLPVVCIVGGPNSNDYGTNRVLHHTIGLPDFSQELRCFQTVTCYQAVVNNLEDAHEQIDTAISTALKESKPVYISIGCNLPAIPHPTFSREPVPFSLSPKMSNQLGLEAAIEAAAEFLNKAVKPVMVGGPKMRVAKACDAFVELADASGYAMAVMPSAKGLVPEHHSHFIGTYWGAVSTAFCAEIVESADAYLFAGPIFNDYSSVGYSLLLKREKAIIVQPDRVVIGNGPAFGCVLMKDFLKGLAKRIKKNTTAFENYSRIFVPEGQPLKCNPTEPLRVNILFQHIQKMLSGDTAVIAETGDSWFNCQKLKLPKGCGYEFQMQYGSIGWSVGATLGYAQAIPEKRVLAFIGDGSFQVTAQDISTMLRCGQKTIIFLINNGGYTIEVEIHDGPYNVIKNWNYTGLVDAIHNGEGKCWTTKVFCEEELLNAIETATGPKKDCLCFIEVIVHKDDTSKELLEWGSRVSAANSRPPNPQ

SEQ ID NO: 6618 - protein, 565 aa, Artemisia annua
SDATLGRHLARRLVQIGVSDVFSVPGDFNLTLLDHLIAEPGLNLVGCCNELNAGYAADGYARCRGVGACVVTFTVGGLSVLNAIAGAYSENLPLICIVGGPNSNDYGTNRILHHTIGLPDFTQELRCFQTVTCYQAVVNNLEDAHELIDTAISTALKESKPVYISISCNLPAIPHPTFTHEPVPFCLSPKLSNHMGLEAAIEAAAEFLNKAVKPVMVGGPKLRVAKACEAFVELSDACGYAVAVMPSAKGLVPEHHNHFIGTYWGAVSTAFCAEIVESADAYIFAGPIFNDYSSVGYSLLLKKEKAIILQPDRVVIGNGPTFGCVLMKDFLQGLAKKLKKNTTAYENYHRIYVPEGHPVKCDPKEPLRVNVLFEHIQNMLSGDTAVIAETGDSWFNCQKLKLPKGCGYEFQMQYGSIGWSVGATLGYAQAAMGKRVIACIGDGSFQVTAQDVSTMLRCGQNTIIFLINNGGYTIEVEIHDGPYNVIKNWNYTGFVDAIQNGEGKCWTSKVHCEEELVKAIETANGAQKDSLCFIEVIVHKDDTSKELLEWGSRVSAANSRPPNPQ

SEQ ID NO: 6619 - protein, 871 aa, Triticum aestivum
MSPAAAAPAPCDDRIRTFEDFARVHQFLLIAAGVPPSLHRRLYHKLAAEVFDGGERFYVEPCEEGRQRRLVLASDTALRGESDVFLVDHAWSFRLSDALKQLREVPGLAERMAALMCVDLDRKTEVEESDEQGSENGGGLEHVLQVLENEKARIQERGSYFAAWLELEELGIDDDMLVALDLSANFPNLVALNLWGNKLQDPEKVMREIGKCGRLKALWLNENPILNQCTEKDVLDGLPELEIYNSHFTRKAREWALGFCGDMVGAENPCLSVGNISLDNIVTLDLSDRSIHKLPEVFSSKLSSLSKLNIRGNPLDQMSGDDLLKLFSGFTQLQELEVDIPGPLGDSAISILESLPNINLLNGVNASTIVENAKHVVDSALRPRVPEWSPEESLAERVIGAMWLYLMTYRLADEEKFDETPIWYVMDELGSAMRHSDDANFRISPFLFMPEGKLASAISYTILWPICDVHTGEECTRDFLFGIGEDKQRSARLTAWFHTPEKYFIQEFRKYQEQLQSTTICPTKEAPSTKSALPSDGRPLRVFTDIPQVEEFLTRPEFVLTTDPKDADIIWAGMQIDSELKSSLGLTDQQYMNQFPFEACLVMKHHLADTIHRAWGSPEWLQPTYNLETHLSQLIGDYSVRKRDGKDNLWIMKPWNMARTIDTTVSGDLSAIIRLMETGPKICQKYIECPALFQGRKFDLRYIVLVRSICPLDILLCDVFWVRLANNQYTLEKTSLFEYETHFTVMNYNGRMNHMNTPEFVKAFEKEHQVKWLEIHESIRIMIRRVFESASAVHPEMQNSFCRAIYGVDVMLDDKFKPKILEVTYCPDCTRACQYDTQALVGSQGPIRGSDFFNTVFGCLFLDDLTNVSPL

SEQ ID NO: 6620 - protein, 250 aa, Triticum aestivum
AAGPFALRLGPRLAAPAVASATRGGGRGSDRPTASRALVSKKSNKDHRLWIRKDSAGSGKKALCLVNTVSKLPNERETVYGALDRWTAFESEFPIIAAAKALEMLKKQRKWLQIIQVTKWLMSKGQVLTWTTYDTLLLALSMDGRVDEAESIWNTILQTYTRSVPKKLFSRMIQIYNTRHLPDKVLEIYADMEELGVRPDEDTTRRIGRAFATSGQEHKQKPVLEKHLKKWKYIHFNGERVRVRRAGPLA

SEQ ID NO: 6621 - protein, 248 aa, Avena sativa
MAGTFALHLGSRLPAPPPASATSGGGGSLPTSIRAMVSKKPNKDHHLWIRKDSAGSGKKALRLVNTVSKLPNEKEAVYCALDRWTAFEPEFPIIAAAKALEMLKKRRKWLRIIQVTKWLMSKGQVLTWTTYDTLLLALSMDGRVDEAESIWNTILQTYTRSVPKKLFSRMIQIYNMRHLPDKVLEIYADMEELGVRPDEDTTRRIGRAFASSGQEEKQKPVLEKYLKKWKYIHFNGERVRVRRAGPLA

SEQ ID NO: 6622 - protein, 311 aa, Triticum aestivum
MSRPLLAMAAAAIVVACCFAACPVGAGASAGGFYDNFVVKWGTDPDPDRRVEIVDGGRLVTITLNNVSGAGFQSRDAFLFGEFTMEMKLVPGDSAGTVTTFYLTSKDPTAVGDGHDEIDFEFLGNVSGEPYLMQTNVFAQGVGGREQRSYLWFDPTEDFHNYTILWNPLNIIFSVDGVPVRVFRNHDANGVPYLTRQAMKVHATIWDGDTWATRGGRVKIDWAHAPFVASYGTYAASACVSAAGNGDQDGAPSAFCCPGDAPSWMARRLGPDGERAVAWARDKYMVMDYCDDPWNLGRPAECDMDSLASAV

SEQ ID NO: 6623 - protein, 303 aa, Pseudoroegneria spicata
MAAAAIVVACCFAACPVGAGASAGGFYENFEVKWGTDPDPNRRVEIVDGGRLVTLTLNNVSGAGFQSRDAFLFGEFTMEMKLVPGDSAGTVTTFYLTSKDPTAAGDGHDEIDFEFLGNVSGEPYLMQTNVFAQGVGGREQRSYLWFDPTEDFHNYTILWNPLNIIFSVDGVPVRVFRNQEANGVPYLSRQAMKVHATIWDGDTWATRGGRVKIDWAHAPFVASYGTYAASACVSAAGNGDQDVASAFCCPGDAASWMARRLGPDGERAVAWARDKYMVMDYCDDPWNLGRPAECDMDSLASAV

SEQ ID NO: 6624 - protein, 302 aa, Leymus cinereus x Leymus triticoides
TVVACCFAACPVGAGASAGGFYENFEVKWGTDPDPDRRVEIVDGGRLVTLTLNNVSGSGFQSRDAFLFGEFTMEMKLVPGDSAGTVTTFYLTSKDPTAVGDGHDEIDFEFLGNVSGEPYLMQTNVFAQGVGGREQRSYLWFDPTEDFHNYTILWNPLNIIFSVDGVPVRVFQNQEANGVPYLTRQAMKVHATIWDGDTWATRGGRVKIDWAHAPFVASYGTYASSACVSAADDGNGDSEGQVGSAFCCPGDASSWMARRLGPDGERAVAWARDKYMVMDYCDDPWNLGRPAECDMDRLASAV

SEQ ID NO: 6625 - protein, 229 aa, Triticum aestivum
MEMKLVPGDSAGTVTTFYLTSKDPTAAGDGHDEIDFEFLGNVSGEPYLMQTNVFTQGVGGREQRSYLWFDPTEDFHNYTILWNPLNIIFSVDGVPVRVFRNHDANGVPYLSRQAMKVHATIWDGDTWATRGGRVKIDWAHAPFVASYGTYAASACVSAAGNDDQEGAPSAFCCPGDASSWMARRLGPDGERPVAWARDNYMVMDYCDDPWNLGRPAECDMDQLQLASVV

SEQ ID NO: 6626 - protein, 304 aa, Triticum aestivum
MAAAAIVVVCCFAACPVSAGASAGGFYDNFVVKWGTDPDPDRRVEIVDGGRLVTLTLNNVSGAGFQSRDAFLFGEFTMEMKLVPGDSAGTVTTFYLTSKDPTAAGDGHDEIDFEFLGNVSGEPYLMQTNVFTQGVGGREQRSYLWFDPTEDFHNYTILWNPLNIIFSVDGVPVRVFRNHDANGVPYLSRQAMKVHATIWDGDTWATRGGRVKIDWAHAPFVASYGTYAASACVSAAGNDDQEGAPSAFCCPGDASSWMARRLGPDGERAVAWARDTYMVMDYCDDPWNLGRPAECDMDQLASAV

SEQ ID NO: 6627 - protein, 243 aa, Hordeum vulgare
MAAAAIVVVACCFAACPVGAGASAGGFYENFEVKWGTDPDPDRRVEIVDGGRLVTLTLNNVSGSGFQSRDAFLFGEFTMEMKLVPGDSAGTVTTFYLTSKDPTAVGDGHDEIDFEFLGNVSGEPYLMQTNVFAQGVGGREQRSYLWFDPTEDFHNYTILWNPLNIIFSVDGVPVRVFRNQEANGVPYLTRRAMKVHATIWDGDTWATRGGRVKIDWAHAPFVGCYGTYAFSACVSGAGDGDGD

SEQ ID NO: 6628 - protein, 488 aa, Triticum aestivum
MATTEKKLHAVLVPFPAQGHVTPMMKLAKVLHCKGFHVTFVNTEYNQRRLVRSRGPDAVASLPGFRFATIPDGIPTSDADADADSTQDPPSLCYYTMTTCLPHLKNLLRDLNGVVGAPPVSCVVGDGVMSFCVDAAAELGVPCALFWTASACGFMGYRNFRFLLNEGLTPLEDEEQVKNGYLDTPVTQAHGMSEHMRLRDFSSFVRTTDRSDVLFNFLLHEVEQSDRATAIILNTIDELEQTALDAMRAILPLPVYTIGPLNFLTEQLVSEGDGSGTLAAIRSSLWREDQSCLEWLQGREPQSVVYVNYGSVTTMSKQELVEFAWGLANCGYDFLWIVRNDLVKGDAAVLPPEFLEATKDRCLLASWCEQEAVIRHEAVGAFLTHCGWNSMMEGLGAGVPMLCWPFFAEQQTNSRYACMEWGVGMEVGDDVRREVVDARIREVMGGEEVGREMRRKAAKWKEVASRSTAQHGGRSLANLESLLKDVLK

SEQ ID NO: 6629 - protein, 483 aa, Triticum aestivum
VFSHLHELDLRYHLSRQTGALNRIIDRGSNAINFILTVTVFNIVPTILEIGMVSSILAYKFGSTFAWITSVSVATYIVFTLALTQWRTKFRTAMNKADNASGAVAVDSLLNYETVKYFNNEQFEVQKYDKYLKRYEDSALKAQSSLAYLNFGQNVIFSVSLSTAMVLSSYGVMSGALTVGDLVMVNGLLFQLSVPLNFLGSVYRESRQSLIDMKSMFQLLEEKPGIKDELHAQPLQFKGGCIEFENVHFGYAPERTILNGATFTVPAGKSVAIVGTSGSGKSTILKLLFRFFDSTSGSIRIDGQDIRGVTLDSLRKSLGVVPQDTVLFNDTIKHNIQYGRLSANDEEVYDAARRASIHDTIMNFPDKYDTVVGERGLKLSGGEKQRVSIARVFLKEPSILLCDEATSALDSTTESSILNSLMSLSVDRTSVFIAHRLTTAMLCDEIIVLENGTVVEQGPHDLLLSKHGRYAELWSQQNTTEGS

SEQ ID NO: 6630 - protein, 484 aa, Triticum aestivum
MATNKKQPHAVLVPFPAQGHVTPMMKLAKVLHRKGFHITFVNTEYNQRRLVRSRVPGAVAGLPGFRFATIPDGIPTSDVDADADAPQDPVSLCYYTMTTCLPHLKNLLRDLNGAVGAPRVSCVVGDGVMSFCMDAAADLGVPCALFWTASACGFMGYRNFRFLLDEGLTPLKDEDQVKNGYLDTPVAQAHGMSKHMRLRDFSSFVRTTDRSDILFNFLLHEVEQSDRATAIVLNTIDELEQTALDAMRAILPLPVYTIGPLNSLTEQLVSQEGDLAGIRSSLWREDQSCLKWLQGREPRSVVYVNYGSVTTMSKQELVEFAWGLANCGYDFLWIVRNDLVKGDAAVLPPEFLEATKGRCLLASWCEQEAVMHHEAVGAFLTHCGWNSMMEGLSAGVPMLCWPFFAEQQTNCRYACMEWGVGVEVGDDVRREAVEARIREVMGGEVGREMRRRAAEWKEVASRSTAQPGGRSLANLESLLKDVLK

SEQ ID NO: 6631 - protein, 393 aa, Brachypodium distachyon
EMSTETTSKRDHEASLRELLAGGDKELMTVARSARRRRLELRRLGRTASAAAEDEGAKRVRPAGPLDSCSSDSSDSAKVTPEPQPVCVSHGAVSVIGRRREMEDAVAVAAPFSAVVEGDGKEEGFFAVYDGHGGSRVAEACRERMHVVLAEEVQRLRGIQQQRGSGSGRDEEEDVIAGWKEAMAACFARVDGEVGVEDEAETGEQTVGSTAVVAVVGPRRIVVANCGDSRAVLSRAGVPVPLSDDHKPDRPDEMERVEAAGGRVINWNGYRILGVLATSRSIGDYYLKPYVIAEPEVTVMDRTDKDEFLILASDGLWDVVSNEVACKIARNCLSGRAASKYPESVSGSTAADAAALLVELAMSRGSKDNISVVVVELRRLRSRTAAVIKENRR

SEQ ID NO: 6632 - protein, 391 aa, Oryza sativa
MAVREVLAGDRKVGTVSRSARRRRLELRRLGRTASAVAEDDAAKRVRPASDSSSDSSESAKVAPEPTAEVARWPACVSHGAVSVIGRRREMEDAIFVAAPFLAASKEAAVEGSGVAEEEGKEEDEGFFAVYDGHGGSRVAEACRERMHVVLAEEVRVRRLLQGGGGGADVEDEDRARWKEAMAACFTRVDGEVGGAEEADTGEQTVGSTAVVAVVGPRRIVVANCGDSRAVLSRGGVAVPLSSDHKPDRPDEMERVEAAGGRVINWNGYRILGVLATSRSIGDYYLKPYVIAEPEVTVMDRTDKDEFLILASDGLWDVVSNDVACKIARNCLSGRAASKYPESVSGSTAADAAALLVELAISRGSKDNISVVVVELRRLRSRTTASKENGR

SEQ ID NO: 6633 - protein, 949 aa, Brachypodium distachyon
MSSKKVPFNRHKENEEARKKREEDEAARVYAEFVESFKGESTSGSKFVRGGVIDPNAKMRTDSEGGKSKDGGSVPKKGSRYVPSFLPPSFGREPEKKKEDERPKEKEKGKPRAIDKFMEELKLEQELRERRNQERDGRHGDTSAPSSRFDELPDEFDPGRLPGSFDDGDPQTTNLYVGNLSPKVDENFLLRTFGRFGPIASVKIMWPRTEEERRRQRNCGFVAFMNRAEGQAAKDEMQGVVVYDYELKIGWGKSVALPSQALPAPPPGHMAIRNKEGGTVIISGPGGPPVASVTPQTSELVLTPNVPDIVVAPPDDSHLRHVIDTMALHVLDGGCAFEQAIMERGRGNALFTFLFDLKSKEHTYYVWRLYSFAQGDTLQRWRTEPFIMITGSGRWVPPALPSSRSPDHEKESTFAAGRSRRVEVERTLTDSQRDEFEDMLRALTLERSQIKEAMGFALDNADAAGEIVEVLAESLTLKETPIPTKVARLMLVSDILHNSSAPVKNASAFRTKFEAAIPDVMESFNDLYRSITGRITAEALKERVLKVLQVWADWFLFSDAYLNGLKATFLRSGNSGVTQFHSLCGDAPEIEKKTSSEDGNNGFRLDEDGALATGKAAATKELLGLPLAELERRCRHNGLSLCGGKETMVARLLSLEEAEKERVYQKDVDVKYGQGEPHRTGRDDIGLNTRSASRFGEGTVADELDMPGLSRYTSQRHSGEPASAEPEQVPSKKQKADPILPDSKWNRDDDVSDDENRKGGQGLGLSYSSGSDIAGEPGKGDTSEIRSDHTSHHQDTIVDEEHRQKLRQIEIAVMQYRESLEENGLRNTEEIERKIASHRRHLQSEYGLTSQMDGANNIRSSERTPLERKERYGNVHDSSRKRPRSPNRSRSPSRKSSSLDRDREHSRSRDKLHGNDVGRDRVREKSANRGKDDHYDRSRDREKDRRKGR

SEQ ID NO: 6634 - protein, 963 aa, Brachypodium distachyon
MSSKKVPFNRHKENEEARKKREEDEAARVYAEFVQSFEGESTSGSKFVRGGVIDPNAKLRAESEGGKSNDRGSAPKKGSRYVPSFLPPPFVREPEKKREDERPKEKEKGKPRAIDTVMEELIFEQQQRERRNQERDSRRGDTSVPSSRFDELPDEFDPTGRLPGSFDDGDPQTTNLYVGNLSPKVDENFLLRTFGRFGPVASVKIMWPRTDEERRRQRHCGFVAFMNRAEAQAAKDEMQGVVVYDYELKIGWGKSVALPSQALPAPPPGHMAIRNKEGSTVVISGPGGLPVASVTPQTSELVLTPNVPDIVVAPPDDSHLRHVIDTMALRVLDGGCAFEQAIMERGRGNPLFSFLFDLKSKEHAYYVWRLYSFAQVSTVLMLLHFQCNLLYDLTGDTLQRWRTEPFIMITGSGRWVPPSLPSSMSVDREKEYTFATGRSRRVEVERTLTDSQRDEFEDMLRALTLERSQIKEAMGFALDNADAAGEIVEVLAESLTLKETSIPTKVARLMLVSDILHNSSAPVKNASAFRTKFEAAIPDVMESFNDLYRSITGRITAEALKERVLKVLQVWADWFLFSDAYLNGLKATFLRSGNSGVTLFHSLCGDAPEIEKKTSCEDDNNGFMLDEDGALATGKAAATKELLGLPLAELERRCRHNGLSLCGGKEMMVARLLSLEEAEKERLYQKDVDMKYGHGESHRTGREDSGFDAHGASRFGKGTGESDMLGLSRHSMETDERRSEESALAECEQVPSKKQKTEPILPASKWNREEDGSDDEERNGEQGLGLSYSSGSDIAGDNGKGDAAESSGNHAIHHPDTIVDGEHRQKLRQIEIAVMQYRESLEEKGLRNMEEIERKVASHRRHLQSEYGLSSSIDGAKNRQSSDRISKERKERYDDARDSSRKRPRSPSRKSSLDRDQEHNRNRDRLHGNDVGRDRAHEKSTRRGKDDYYSGSRDREKDRSKGR

SEQ ID NO: 6635 - protein, 970 aa, Oryza sativa
MSSKKVPFHRHKENEEARKKREQDEAARVYEEFVESFKGDSTSGSKFVRGGVIDPNAKLRIDSEGGKSKDGGSVPKKGSRYVPSFLPPSFGKEPDKKKEEERPKEKERRKPRVIDEFMEELKFEKELRQKRNQEREQWREGRHTDTSASSSRFDELPDELDPIGKLPGSFDDGDPQTTNLYVGNLSPKVDENFLMRTFGRFGPIASVKIMWPRTEEERRRQRNCGFVAFMNRADGQAAKDEMEGVVVYDYELKLGWGKSVALPSQALPAPPPGHMAIRNKEGGTVILSGPGGPPLASVKPQTSELVLTPNVPDIVVAPPDDAHVRHVIDTMALHVLDGGCAFEQAVMERGRGNSLFSFLFDLKSKEHTYYVWRLYSFAQGSGDSILLEVNCDSKEGDTLQRWRTEPFIMITGSGRWVPPALPSSRSPEREKESTFAAGRSRRVEVERTLTDSQRDEFEDMLRALTLERSQIKEAMGFALDNADAAGEIVEVLTESLTLKETPIPTKVARLMLVSDILHNSSAPVKNASAFRTKFEAALPDVIESFNDLYRSITGRITAEALKERVLKVLQVWADWFLFSDAYLNGLRATFLRSSHLGVIPFHSLCGDTPEIEKKASSEDGSDGFRLNEDGALATGKAAATRELLGLPLAELERRCRHNGLSLCGGKEMMVARLLSLEEAEKERVYEKDAGIKYGQGESHRTGRDDIAVNARNASRPGEGTDSGESDMLGLSHYAMEAGYKRSNESTPAEPVPSKKPKVDPVLPASKWSREDDVSDDEDRKGGRGLGLSYSSGSDIAGDSGKADATEVSTDHSNHHQDTILDEEHRKKLRQIEIAVMQYRESLEEKGLRNTEEIEKKVASHRRRLQSEYGLSFSNDGANSRRSSERTSSERRDRHDDSSRKRHRSLSRSRSPPRRSLERDREHNRNRDTDRSHGNDAGRERDRVREKSASRGRDDHYDRSRDREKDRRKGR

SEQ ID NO: 6636 - protein, 956 aa, Zea mays
MSSKKVPYHKHREAEEARKKREEDEAARVYAEFVESFKGDSSSGAKFIRGGVIDPNAKLKTDSEGGKSKDGGSVPKKGSRYVPSFLPPSFAKEPEKKKEGERPKEKEKGKPRVIDRFLEEIKLEQEQREKRHQDRDHRREGRHGDSSMSSSRFDELPDEFDPTGRFPGSFDDGDPQTTNLYVGNLSPKVDENFLLRTFGRFGPIASVKIMWPRTEEERRRQRNCGFVAFMNRTDGQAAKDEMQGVIVYDYELKIGWGKSVALPSQALPAPPPGHMAIRNKEGGTATVILSGPGGPAVASIKPQTSELVLTPNVPDIVVAPPDDGHLRHVIDTMALHVLDGGCAFEQAVMERGRGNPLFDFLFNLKSKEHTYYVWRLYSFAQGDTLQRWRTEPYIMITGSGRWVPPPLSSNRSPEREKESTFAAGRSRRVEVERTLTDSQRDEFEDMLRALTLERSQIKDAMGFALDNADAAGEIVEVLTESLTLKETSIPTKVARLMLVSDILHNSSAPVKNASAFRTKFEASLPDVMESFNDLYRSITGRITAEALKERVMKVLQVWADWFLFSDAFLNGLRATFLRSGNSGVVPFHSLCGDAPEIEKKGSSEDGNDGFKLNEDGALATGKAAATKELLGLPLAELERRCRHNGLSLCGGKEMMVARLLNLEEAEKERIYEKDVDMKYVQGEQHVVGREDSGVNAHSTSRFGEGSNGDELDVSRNSTRAGKGRSGGSASAELESFPSKKPKYDPVLPASKWSREDDISDDEDRKGGRGLGLSYSSGSDIADGLGKVDTTEASTDHTSRHHDTIVDEEHRQKLRQIEISVMQYRESLEEQGLRDLDEIERKVASHRRRLQSEYGLSTPADGANSRRSSERTSSSSERKERHRDAHDHPRKRGRSQSRSLSPPRKSQERDREHNRGRDRSHGNDVGRDRVRGKSASQGRDDHHDRSRDREKDRRKGR

SEQ ID NO: 6637 - protein, 949 aa, Zea mays
MSSKKVPYHKHREAEEARKKREEDEAARVYAEFVESFKGDSSSGAKFIRGGVIDPNAKLKTDSEGGKSKDGGSVPKKGSRYVPSFLPPSFAKEPEKKKEGERPKEKEKEKGKPRVIDRFLEEIKLEQEQREKRHQDRDHRREGRHGDSSMSSSRFDELPDEFDPTGRFPGSFDDGDPQTTNLYVGNLSPKVDENFLLRTFGRFGPIASVKIMWPRTEEERRRQRNCGFVAFMNRTDGQAAKDEMQGVIVYDYELKIGWGKSVALPSQALPAPPPGHMAIRNKEGGTATVILSGPGGPAVASIKPQTSELVLTPNVPDIVVAPPDDGHLRHVIDTMALHVLDGGCAFEQAVMERGRGNPLFDFLFNLKSKEHTYYVWRLYSFAQGDTLQRWRTEPYIMITGSGRWVPPPLSSNRSPEREKESTFAAGRSRRVEVERTLTDSQRDEFEDMLRALTLERSQIKDAMGFALDNADAAGEIVEVLTESLTLKETSIPTKVARLMLVSDILHNSSAPVKNASAFRTKFEASLPDVMESFNDLYRSITGRITAEALKERVMKVLQVWADWFLFSDAFLNGLRATFLRSGNSGVVPFHSLCGDAPEIEKKGSSEDGNDGFKLNEDGALATGKAAATKELLGLPLAELERRCRHNGLSLCGGKEMMVARLLNLEEAEKERIYEKDVDVKYVQGEQHVVGREDSGVNAHSTSRFGEGSNGDELDVSRNSMRAGKGRSGGSASAELESFPSKKPKYDPVLPASKWSREDDISDDEDRKGGRGLGLSYSSGSDIADGLGKVDTTEASTDHTSHHHDTIVDEEHRQKLRQIEISVMQYRESLEEQGLRDLDEIERKVASHRRRLQSEYGLSTPTDGANSRRSSERTSSSSERKERHGDAHDHPRKRRRSQSRSCSPPRKSQERDREHNRSRDRDRVREKSASRGRDDHHDRSRDREDRRKGR

SEQ ID NO: 6638 - protein, 748 aa, Triticum aestivum
MLHELLLALLGFTGDFVLDNSSARRRPEPAEAGGAGDGDVGPAFRLAPDLTFLQPSERSAIERLISLGFYYRELNRFATESRDLSWIQSSVEVSSPNADITLNGKVRKGSAYRRAIANGIAEILSVYRSAVLQVEQNLLSDPLRILATVTHGLNKFEVLLPPLYELVMEIEQKDIKGGQLLNLLHKRCHCGVPELQSCIQRLLWHGHQVMFNQLTSWMVYGILQDQYHEFFIRRQVDRDEENESAQSDVADKFAQKLAKDTSLTSWHSGFHVSLDMLPEYIHMRVAESILFAGKAIRVLRNPSPGATLLERTNQSQTLKGSHRMQSFTGGPGALKELPNFSNISAEELLPQAEADKVDAMLKQLKHASEFHKRLFESAVSSIRTIAANHLWQLVVVRADLNGHLKALKDYFLLAKGDFFQCFLEESRQLMRLPPRQSTAEADLIVPFQLAALKTIGDEDKYFTRVSLRMPLFGMKSSTSQKDLQKSNTSDLSLQGKASSELALDGWHSIALEYSVDWPLQLFFTPDILSKYRKVFQYLIRLKRTQMELEKSWTAVMHQDHVDFSDYCKDRKNSSATQLRRLRTKPFWRVREHMAFLIRNLQFYIQVDVIESQWNVLQTHVQDSHDFTELVTFHQDYLSALISQSFLDIGSVSRILDSIMKLCLQFCWSIEQYETGANMFEIDHITEEFNKKSNSLYTILRSSRLAGSQRAPFLRQFLMRLNFNSFFETTARGVMNSGRLRPGTASTQL

SEQ ID NO: 6639 - protein, 745 aa, Brachypodium distachyon
MLHELLLALLGFTGDFVLDSSSSARRRSSSADAVGAGDGDVGPAFRLAPDLTFLQPSERSAIERLISLGFYYRELNRFATESRDLSWIQPSVDVSSPHADVTLKGKVRKGSSYRRAIANGIAEILSVYRSAVLQVEQNLLSDPLPILATVTHGLNKFEVLLPPLYELVMEIEQKDIKGGQLLNLLHKRCHCGVPELQSCIQRLLWHGHQVMFNQLTSWMVYGILQDQYHEFFIRRQVDRDVENESSQTDVADKVAQKLAKDTSLTSWHSGFHLSLDMLPEYIHMRVAESILFAGKAIRVLRNPSPGATLQDPSVLKGSHRTQSSTGGSGAPKELPNFSTISAEELLPQAEADKVDAMLKNLKHSSEFHKRLFESAVSSIRTIAANHLWQLVVVRADLNGHLRALKDYFLLAKGDFFQCFLEESRQLMRLPPRQSTAEADLIVPFQLAALKTIGDEDKYFHRVSLRMPLFGMKSSTSQKDLQKPNTSELSSQGKASSELALDGWHSITLEYSVDWPLQLFFTPDVLSKYRKVFQYLIRLKRTQMELEKSWTAVMHQDHVDFSDYCKDRKNSSATQLRRLRTKPFWRVREHMAFLIRNLQFYIQVDVIESQWNVLQAHVQDSHDFTELVTFHQDYLSALISQSFLDIGSVSRILDSIMKLCLQFCWSIEQYETGSNMFEIDHITEEFNKKSNSLYTILRSSRLAGSQRAPFLRQFLMRLNFNSFFETTARGVMNSGRLRPSTASTQL

SEQ ID NO: 6640 - protein, 752 aa, Sorghum bicolor
MLHELLLALLGFTGDFVLDASPPRRRAASQEAGGDGDGDGDGEVGPAFRLAPDLTFLQPSERTAIERLISLGFYYRELNRFATESRDLSWIQSSVDVSSPHSDKTQKGKVRKGSVYRRAIANGITEILSVYRSAVLQVEQNLLSDPLPILATVTHGLNKFEVLLPPLYELVMEIEQKDIKGGQLLNLLHKRCHCGVPELQSCIQRLLWHGHQVMFNQLTSWMVYGILQDQYSEFFIRRQDDRDGENESSQRDVSDKFKQKLAKDTSLASWHTGFHVSLDMLPEYIHMRVAESILFAGKAIRVLRNPSPGATLQEPVNQSQNSKGSHGMQSFVGGSGAPKELPSFSNISAEELLPQTEADKIDVMLKELKHSSEFHKRPFESAVGSIRTIAANHLWQLVVVRADLNGHLKALKDYFLLAKGDFFQCFLEESRQLMRLPPRQSTAEADLMIPFQLAALKTIGEEDKYFTRVSLRMLSYGMKSSTSQKDLQKPNASELSSQGKATSEIALDGWDSIALEYSVDWPLQLFFTPDVLSKYRKVFQYLIRLKRTQMELEKSWAAVMHKDHADFSEYCKDRKNNSATQLRRQRSKPLWRVREHMAFLIRNLQFYIQVDVIESQWNVLQSHVQDSHDFTELVSFHQEYLSALISQSFLDIGSVSRILDSIMKLCLQFCWSIEQYETRPNISEIDHITEEFNKKSNSLYTILRSSRLAGSQRAPFLRQFLMRLNFNSFFETTARGVMNSGRLRPSTAGAQL

SEQ ID NO: 6641 - protein, 754 aa, Oryza sativa
MLHELLLALLGFTGDFVLDAASSPSATRRRRPVPPEAAAGGDVGPASFRLAPDLTFLQPSERSAIERLISLGFYYRELNRFATESRDLSWINSPIDVSPTHGEKTVKAKVRKGSAYRRAIANGIAEILSVYRSAVLQVEQNLLSDPLPILATVTHGLNKFEVLLPPLHELVMEIEQKDIKGGQLLNLLHKRCHCGVPELQSCIQRLLWHGHQVMFNQLTSWMVYGILQDQYNEFFIRRQEDRDKENDSSQVDVADKFTQKSAKETSLTSWHTGFHVSLDMLPEYIHMRVAESILFAGKAIRVLRNPSPGATLQESMNQSQNVKGSYRMQSLIGGSGALKELPNFPNISAEELLPQAEADKIDAMLKELKHSSEFHKRLFESAVGSIRTMAANNLWQLVVVRADLNGHLKALKDYFLLAKGDFFQCFLEESRQLMRLPPRQSTAEADLMVPFQLAALKTIGDEDKYFARVSLRMSSFGIKASTSQKDLQKSSTPEISSQGKATSELALDGWDSIALEYSVDWPLQLFFTPDVVSKYRKVFQYLIRLKRTQMELEKSWAAVMHQDHADFSDYCKDRKNGDATQLRRQRSKPFWRVREHMAFLIRNLQFYIQVDVIESQWNVLQAHVQDSHDFTELVTFHQEYLSALISQSFLDIGSVSRILDSIMKLCLQFCWSIEQYENRRNMLEIDHITEEFNKKSNSLYTILRSSRLAGSQRAPFLRQFLMRLNYNSFFETTARGVMNSAGGRLRPSTAGTQL

SEQ ID NO: 6642 - protein, 747 aa, Zea mays
MLHELLLALLGFTGDFVLDVSLPRRRAASQDAGEDGNGDGEVGPSFRLAPDLTFLQPSERTAIERLISLGFYYRELNRFATESRDLSWIQSSIDVSSPHSDNTQKGKVRKGSVYRRAIANGITEILSVYRSAVLQVEQNLLSDPLPILATVTHGLNKFEVLLPPLYELVMEIQHKDIKGGQLLNLLHKRCHCGVPELQSCIQRLLWHGHQVMFNQLTSWMVYGILQDQYSEFFIRRQDDRDVENESSQRDVSDKLKQKLAKDTSLASWHTGFHVSLDMLPEYIHMRIAESILFAGKAIRVLRNPSPSATLQDPVIRTVGSHGMQSSVGGSGVPKELANFSNIRAEELLPQAEADKIDSMLKELKHSSEFHKRPFESAVGSIRTIAANHLWQLVVVRADLNGHLKALKDYFLLAKGDFFQCFLEESRQLMRLPPRQSTAEADLMIPFQLAALKTIGEEDKYFTRVSLRMLSYGMKSSTSQKDLQKPNASELPSQGKAASELTLDGWDSIALEYSIDWPLQLFFTPDVLSKYRKVFQYLIRLKRTQMELEKSWAAVMHKDHADFSDYCKDRKNNSATQLRRQRSKPLWRVREHMAFLIRNLQFYIQVDVIESQWNVLQSHVQDSHDFTELVSFHQEYLSALVSQSFLDIGSVSRILDSIMKLCLQFCWSIEQYETRPNISEIDHITEEFNKKSNSLYTILRSSRLAGSQRAPFLRQFLMRLNFNSFFETTARGVMNSGRLRPITAGAQL

SEQ ID NO: 6643 - protein, 744 aa, Triticum aestivum
MAYHHLLVVSPPAQPPPPPRRLSLLSRSPRGAVTAAASPDAARSSSVVASSAATRRRAVLLVGISVLPLLRLRDAATSAAQPSAVDLVTDKMDIQMSEEMQPEETRAGPPQPEVKRPSPGNPLASLLNTIAVIASGLLAGLLGTTQREKKALQSAISSMEIKLAEDEAAMSLLRENYEKRLLDEQVAQKKQARMFQDEEASLLDRLASTKRTVKNLNEEVMKEKELVEQLKHEIHDLEISIAQAEEDKHAFEENLRDKLETLDILHGKVNLLSQDVNDKEENITELSSSLSTKEGDYQSLHLMFNQTKESLEHANSRMEQLEKYVYAAKNDIKSKISSIDSLNEDVQTLCSAKSDAEEKISELMKQYTELETASKMRASRDSELLSNKDGQLNQLEERLSTALSDSSEDRSIIAELNSELEANRTMLLNEVETRKKMSDLVQSTEDALKESRNELFKLSEELNAVNISNHDLTTQISEFTNESNEVKQALTKKVEEAESVSKALSDELASVKEIHQKTQEDLEVTSNQLVSITEVHDELSKELLDTYKKLESTTDELVRERRINATLKRELEALVKQSQVESEARRALQADLDEATLSLNEVNESTLFLSNKLDSTVSRISAIKEEKEVLSAALSEQKKSTAEAQKNMVDAQHLIKRLGMERENSEIRSTKLEEELATAKGEMLYLRRQITASGSQNTDVLEASPTPNFNQSPEDRVPNTSSTDAVPPRSAKKIYRRRKDRPST

SEQ ID NO: 6644 - protein, 258 aa, Triticum aestivum
MAASLPSLPPPPTPSPAATTLASNLLSFPAPRPRLAATHRRAVVAAASSRPPPPPPPPPSPEGGDEEVERAMGMDGGIPGTSGELLRRVSSRAYGMRRHLMESLDSLAYDVLETNPWREQHPKPVYVLARRDNQLWTMKTRRNRSEVERELGMLFSKGGGSGVGTKSKYSGSKFSMVVEDLTEGVLVFEDEDDAAKYCDLLQGGGQGCEGIAELEASSVFNMCRQMKALAVLFRRGRTPPTPQSLERDLRARNRSLED

SEQ ID NO: 6645 - protein, 255 aa, Pseudoroegneria spicata
MAASLPSLPPPPPSPAATTLASNLLSFPAPRPRLAATHRRAVVAAASSRPPPPPPPSPEGGDEEVERAMGMDGGIPGTSGELLRRVSSRAYGMRRHLMESLDSLAYDVLETNPWREQHPKPVYVLARRDNQLWTMKTRRNRSEVERELGMLFSKGGASGVGTKSKYSGSKFSMVVEDLTEGVLVFEDEDDAVKYCDLLQGGGQGCEGIAELEASSVFNICRQMKALAVLFRRGRTPPTPQCLERDLRARNRSLED

SEQ ID NO: 6646 - protein, 268 aa, Triticum aestivum
HELCSARTVKMAASLPSLPPPPTPSPAATTLASNLLSFPAPRPRLAATHRRAVVAAASSRPPPPPPPPPSPEGGDEEVERAMGMDGGIPGTSGELLRRVSSRAYGMRRHLMESLDSLAYDVLETNPWREQHPKPVYVLARRDNQLWTMKTRRNRSEVERELGMLFSRGGGSGVGTKSKYSGSKFSMVVEDLTEGVLVFEDEDDAAKYCDLLQGGGQGCEGIAELEASSVFNMCRQMKALAVLFRRGRIPPTPQSLERDLRARNRSLED

SEQ ID NO: 6647 - protein, 253 aa, Brachypodium distachyon
MAASFPSLPPPPSPAATALASNLLSFPAPRARLAAAPRRAVVAAASSRPPPPPSPEGGGEEEEEVERALGMDGSIPGTSGELLRRVSSRAYGMRRHLMESLDSLAYDVLETNPWREQPKPVYVLARRDNQLWTMKTRRNRSEVERELGMLFSKGGGSGVGTKSKYGSKFSMLVEDITEGVLVFEDKDDAVKYCDLLQGGGQGCEGIAELEASSVFNICHKMKALAVLFRRGRTPPMPQSLQRDLRARNRSLED

SEQ ID NO: 6648 - protein, 262 aa, Sorghum bicolor
MAASSPPLPPPPPAASSTTLAGNLTASSLLSIPRPRPRLAAAHRRAVVAASVSPRPRPPQPSPEGDGDEKEVERAMGMDGGIPGTSDEFLRRVSSRAYGMRRHLMESLDSLAYDVLETNPWREDSKPVYVLARSDNHLWTMKTRRSRNEVERELGKLFSKGGGSGVGTKSKYSGSKFNMVVEDIREGVLIFEDEDDAVKYCDLLQGGGQGCEGIAEIEASSVFNMCRNMKALAVLFRRGRTPPLPQSLERDLRARKRSPLED

SEQ ID NO: 6649 - protein, 261 aa, Setaria italica
MATSSPSLPPPPPAAASTTLAGNLTASSLLSIPPPRPRLAAAHRRAVVAAAASPRPPPPPSQEGDGGDEQEVERAMGMDGGIPGTSGEFLRRVSSRAYGMRRHLMESLDSLAYDVLETNPWREDSKPVYVLARSDNHLWTMKTRRSRNEVERELGMLFSKGGGSGVGTKSKYSGSKFNMVVEDIREGVLVFEDEDDAVKYCDLLQGGGQGCEGIAEIEASSVFSMCQKMKALAVLFRRGRTPPLPQSLERDLRARKRSMED

SEQ ID NO: 6650 - protein, 265 aa, Oryza sativa
MAACLPSLSPPPHQAPVPAATTALAGNLTSSLLSLPPPLPRLAVSHRRAVVAAASSRPPPPPSREGGDGGGEEEEEVERAMGMDGGIPGTSGEFLRRVSSRAYGMRRHLMESLDSLAYDVLETNPWREDSKPVYVLARRDNHLWTMKTRRSRSEVERELGMLLKGGGSGVGTKSKYSGSKFNMLVEDIREGILVFEDEDDAAKYCDILQGGGQGCEGIAEIEASSVFNICHKMKALAVLFRRGRTPPLPQSLERDLRARKRSLED

SEQ ID NO: 6651 - protein, 428 aa, Brachypodium distachyon
MYGVGGGGGGFNASSTASGRRRNQEEDEEDDEEETGDGRVLEAWERAYADDRSWEALQEDESGLLRPIDTKNLVHSQYRRRLLLRSAAAAVRIQKGLIRYLYIVIDLSRAASEMDYRPSRMAVVAKCAEAFIREFFDQNPLSHVGLVTIKDGISHRLTDIGGSPESQIKALMGKLECSGDSSLQNALELIHGYLNQIPSYGHKEVLILYSALNTCDPGDVMETVEKCKKSKIRCSVIGLAAEIFICKHLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFPVAPFDEVTFKLGQKGGQNCYGCQQSLINSDSQSNLHVRCPKCNQHFCFDCDIYIHESLHNCPGCESQRSFSS

SEQ ID NO: 6652 - protein, 431 aa, Sorghum bicolor
MYGVGGGGGGFNAPSTTAGRRRNPGDEEEDEEEEGGEGRVLEAWERAYADERSWESLQEDESGLLHPIDTKALVHSQYRRRLLLRSAAAAAARIQKGLIRYLYIVIDLSRAASEMDYRPSRMAVVAKHAEAFIREFFDQNPLSHVGLVTIKDGIAHRLTEIGGSPESQIKALMGKLECSGDSSLQNALELVHGYLDQVPSYGHKEVLILYSALNTFDPGDIMETITKCKKSKIRCSVIGLAAEIFICKHLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFPVAPFDEVTPVPNRIQRGGQICFSCQQSLFNPDGQSNLHVRCPKCNQHFCLDCDIYIHESLHNCPGCESQRNITL

SEQ ID NO: 6653 - protein, 431 aa, Panicum virgatum
MYGVGGGGGFNAPSTTSGGRRRNPGDEEDDEEEEGGEGRVLEAWERAYADDRSWETLQEDESGLLHPIDTKTLVHAQYRRRLLLRSAAAAAARIQKGLIRYLYIVIDLSRAASEMDYRPSRMAVVAKHAEAFIREFFDQNPLSHVGLVTIKDGISHRLTDIGGSPESQIKALMGKLECSGDSSLQNALELVHGYLDQVPSYGHKEVLILYSALNTCDPGDIMETIEKCKKSKIRCSVIGLAAEIFICKHLCDETGGSYTVALDESHFKELLLEHAPPPPAIVEYAAANLIKMGFPQRGAEDLISICSCHKKIKSGAEGYICPRCKVNVCELPTECRTCGLTLVSSPHLARSYHHLFPVAPFDDVSSVPNRIQRGAQNCFGCQQNLFNPDGQASLHVRCPKCNQHFCLDCDIYIHESLHNCPGCESQRGFSS

SEQ ID NO: 6654 - protein, 428 aa, Zea mays
MYGVGGGFNAPSTAASRRRNPGDEEEDEEDEGGEGRVLEAWERAYADERSWESLQEDESGLLRPVDTKTLVHAQYRRRLLLRSAAAAAARIQKGLIRYLYIVIDLSRAASEMDYRPSRMAVVAKHAEAFIREFFDQNPLSHVGLVTIKDGIAHRLTEIGGSPESQIKALMGKLECSGDSSLQNALDLVHGYLDQVPSYGHKEVLILYSALNTFDPGDITETIAKCKKSKIRCSVIGLAAEIFICKHLCEETGGSYTVALDESHFKELLLEHAPPPPAIAEYAAANLIKMGFPQRGAEELISICSCHKKIKSGAEGYICPRCKVNVCELPTECRTCGLTLVSSPHLARSYHHLFPVPPFDEVTPVPNRIQRGGQICFSCQQSLYNPDGQSNLHVRCPKCNQHFCLDCDIYIHESLHNCPGCESQRSIAS

SEQ ID NO: 6655 - protein, 382 aa, Triticum aestivum
AYADDRSWEALQEDESGLLRPIDTKNLVHSQYRRRLLLRSAAAAARIQKGLIRYLYIVIDLSRAASEMDYRPSRMAVVAKCAEAFIREFFDQNPLSHVGLVTIKDGISHRLTEIGGSPESQINALMGKLECSGDSSLQNALELVNGYLNQIPSYGHKEVLFLYSALNTCDPGDVMETIEKCKKSKVRCSVIGLAAEIFICKHLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFPVTPFDEVTFKLGQKGGQNCFGCQQSLINTGGQSNIHVRCPKCKHHFCFDCDIYIHESLHNCPGCESQRSSSR

SEQ ID NO: 6656 - protein, 382 aa, Triticum aestivum
  misc_feature (348)..(348): Xaa can be any naturally occurring amino acid
AYADDRSWEALQEDESGLLRPIDTKNLVHSQYRRRLLLRSAAAAARIQKGLIRYLYIVIDLSRAASEMDYRPSRMAVVAKCAEAFIREFFDQNPLSHVGLVTIKDGISHRLTEIGGSPESQINALMGKLECSGDSSLQNALELVNGYLNQIPSYGHKEVLFLYSALNTCDPGDVMETIEKCKKSKVRCSVIGLAAEIFICKHLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFPVTPFDEVTFKLGQKGGQNCFGCQQSLINTGGQSNIHVXCPKCKHHFCFDCDIYIHESLHNCPGCESQCSSSR

SEQ ID NO: 6657 - protein, 448 aa, Oryza sativa
MYGVGGGGGGFNAPYTASARRRNHEDDDDEEEEESGEGRVLEAWERAYADDRSWEALQEDESGLLRPIDTKTLVHAQYRRRLLLRSAASAAARIQKGLIRYLYIVIDLSRVVNKILFGTAPDLRSMAASEMDYRPSRMAVVAKYAEVFIREFFDQNPLSHVGIVTMKDGISHRLTEIGGSPESQIKALMGKLECSGEPSLQNALELVHGYLDQVPSYGHKEVLFLYSALNTCDPGDIMETIAKCKKSKIRCSVIGLAAEIFICKYLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFPVQPFDEVSSVHPNRLGQKGGQKCYGCQQSFINPDSQSSLHVRCPKCNQHFCLDCDIYIHESLHNCPGCESQRSSS

SEQ ID NO: 6658 - protein, 403 aa, Triticum aestivum
MAPSTSSASALLHLPGLPPRGPHRGGCRNHPRRPRHAAVRCSFAFAPVETARIKVVGVGGGGNNAVNRMIGSGLQGIEFYAINTDSQALVNSQAQHPLQIGEQLTRGLGTGGNPNLGEQAAEESKEVIANALRDSDLVFITAGMGGGTGSGAAPVVAQIAKEAGYLTVGVVTYPFSFEGRKRSLQALEALEKLERSVDTLIVIPNDRLLDIADENMPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYNGEIHVTIIATGFPQSFQKSLLADPKGARILEAKEKAASLATAAAAQQPAAAVPTWSRRLFS

SEQ ID NO: 6659 - protein, 258 aa, Avena sativa
LRIPISPQGQMAPSTSSAATLLHLPGLPPRGPQQHGGCRSQPRRRPRHAAVRCSSFAFAPVETARIKVVGVGGGGNNAVNRMIGSGLQGIEFYAINTDSQALVNSQAQHPLQIGEQLTRGLGTGGNPNLGEQAAEESKEVIANALRDSDLVFITAGMGGGTGSGAAPVVAQIAKEAGYLTVGVVTYPFSFEGRKRSLQALEALEKLERSVDTLIVIPNDRLLDVADENMPLQDAFLLADDVLRQGVQGISDIITILGL

SEQ ID NO: 6660 - protein, 413 aa, Brachypodium distachyon
SNLTLPATMAPSTSSASTLLHLPPGLHPPRGPQRGGWLDHPRRRRPRHAAVRCSFAFAPVETARIKVVGVGGGGNNAVNRMIGSGLQGIEFYAINTDSQALVNSQAQHPLQIGEQLTRGLGTGGNPNLGEQAAEESKEVIANALRDSDLVFITAGMGGGTGSGAAPVVAQIAKEAGYLTVGVVTYPFSFEGRKRSLQALEALEKLERSVDTLIVIPNDRLLDVADENMPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYTGEIHVTIIATGFPQSFQKSLLADPKGARILEAKEKAASLASVGAQQQAPAPTWSRRLFS

SEQ ID NO: 6661 - protein, 404 aa, Oryza sativa
MASAACSSSASALVRLTGPIHLCSAPPRGSARRRHASVRCSFAPVETARIKVVGVGGGGNNAVNRMIGSGLQGIEFYAINTDSQALLNSQAQYPLQIGEQLTRGLGTGGNPNLGEQAAEESKEAIANALKDSDLVFITAGMGGGTGSGAAPVVAQISKEAGYLTVGVVTYPFSFEGRKRSLQASALEALEKLERSVDTLIVIPNDRLLDVVDENTPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYTGEIHVTIIATGFPQSFQKSLLADPKGARIMEAKEKAANLTYKAVAAATVQPAPAATWSRRLFS

SEQ ID NO: 6662 - protein, 405 aa, Sorghum bicolor
MASSAAASSSASALVRLPGPGHLRALPRSGWRDHRRPRRAIVRCSFAPVETARIKVVGVGGGGNNAVNRMIGSGLQGIEFYAINTDSQALINSQAQYPLQIGEQLTRGLGTGGNPNLGEQAAEESREAIATALRDSDLVFITAGMGGGTGSGAAPVVAQISKEAGYLTVGVVTYPFSFEGRKRSLQALEALEKLEKSVDTLIVIPNDKLLDVADENMPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYTGEIHVTIIATGFPQSFQKSLLADPKGARIVESKEKAATLAHKAAVAAVQPVPASAWSRRLFS

SEQ ID NO: 6663 - protein, 405 aa, Zea mays
MASSAAAASSASALFRLPGSGHLRAPPRSGWRDHRRSRRATVRCSFAPVETARIKVVGVGGGGNNAVNRMIGSGLQGIEFYAINTDSQALINSQAQYPLQIGEQLTRGLGAGGNPNLGEQAAEESRETIATALRDSDLVFITAGMGGGTGSGAAPVVAQISKEAGYLTVGVVTYPFSFEGRKRSVQALEALEKLEKSVDTLIVIPNDKLLDVADENMPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYTGEIHVTIIATGFPQSFQKSLLADPKGARIVESKEKAATLAHKAAAAAVQPVPASAWSRRLFS

SEQ ID NO: 6664 - protein, 244 aa, Panicum virgatum
MASSAAGSSASALLRLQGPAHLRAPPRSGWRDHRRPRRTTARCSFAPVETARIKVVGVGGGGNNAVNRMIGSGLQGIEFYAINTDSQALITSQAQYPLQIGEQLTRGLGTGGNPNLGEQAAEESREAIATALKDSDLVFITAGMGGGTGSGAAPVVAQISKEAGYLTVGVVTYPFSFEGRKRSLQALEALEKLEKSVDTLIVIPNDKLLDVADENMPLQDAFLLADDVLRQVFKEYRTSSRYLD

SEQ ID NO: 6665 - protein, 361 aa, Setaria italica
RAPVETARIKVVGVGGGGNNAVNRMIGSGLQGIEFYAINTDSQALITSQAQYPLQIGEQLTRGLGTGGNPNLGEQAAEESREAIATALRDSDLVFITAGMGGGTGSGAAPVVAQISKEAGYLTVGVVTYPFSFEGRKRSLQALEALEKLEKSVDTLIVIPNDKLLDVADENMPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYTGEIHVTIIATGFPQSFQKSLLADPKGARIAEAKEKAATFAHNKAAAAVVQPAPASAWSRRLFS

SEQ ID NO: 6666 - protein, 326 aa, Gossypium hirsutum
MAATFFRRLSKATPATFNNAFRGQPKSGFAGFRFTTIAAVAGGISTYYCFSDSNLVHLDQVNEETGPKVALKSDKWLEFKLQDTARVSHNTHLFRFSFDPSAKLGLDVASCILTRAPLGQDAEGKTKYVIRPYTPISDPDAQGYFDLLIKVYPEGKMSQHFASLKPGDVVEVKGPIEKLRYSPNMKKHIGMIAGGTGITPMLQVIEAILKNPDDKTQVSLLYANVSPDDILLKQKLDILAASHPNLKVLYTVDNPTKTWKGGAGFISKDMVTKCLPGPAEDTLILVCGPPGMMEHISGGKAKDYSQGELTGILKELGYTEQMVYKF

SEQ ID NO: 6667 - protein, 326 aa, Theobroma cacao
MATTFFRRLAKATPPSFTDAFGGQPKAGFAGFRFSAIAAVAGGISSYYYFSESNLVHLDQINEETGPKVALKSDKWIGFKLQDTARVSHNTQLFRFSFDPTSKLGLDVASCILTRAPLGQDAEGKTKYVIRPYTPISDPDAKGYFDLLIKVYPEGKMSQHFASLKPGDVVEVKGPIEKLRYSPNMKKHIGMIAGGTGITPMLQVIEAILKKPDDNTQVSLLYANVSPDDILLKQKLDILAASHPNLKVFYTVDNPSKNWKGGAGYISKDMVTKGLPGPGEDTLILVCGPPGMMKHISGDKAKDYSQGELTGILKELGYTEQMVYKF

SEQ ID NO: 6668 - protein, 147 aa, Theobroma cacao
MATTFFRRLAKATPPSFTDAFGGQPKAGFAGFRFSAIAAVAGGISSYYYFSESNLVHLDQINEETGPKVALKSDKWIEFKLQDTARVSHNTQLFRFSFDPTSKLGLDVASCILTRAPLGQDAEGKTKYVIRPYTPISDPDAKGSLTC

SEQ ID NO: 6669 - protein, 328 aa, Citrus sinensis
MATTFFRRLAKATPIAFNEAFGGQPKSDFNKFRFPFGAIAAVAGGVSYYCYFSSPNLVHLDQINEETGPKIALNPDKWIGFKLQDTARVSHNSHLFRFSFDPSAKLGLDVASCILTRAPLGQDAEGNTKYVVRPYTPISDTEAKGHFDLLIKVYPEGKMSQHFASLKPGDVVEVKGPIEKLRYSPNMKKHIGMIAGGTGITPMLQVIEAILKNPDDNTQVSLLYGNISPDDILLKQKLDILAASHPNLKVFYTVDNPTKNWKGGVGYISKDTALKGLPSPSDDALILVCGPPGMMKHVSGEKAKDYSQGELSGILKDLGYTEQMVYKF

SEQ ID NO: 6670 - protein, 332 aa, Quercus alba
MATFFFKRLARATPIALNNALSFGGANKTKSGFSGFRIPIGAIAAVSGGISYYYCFSSSNLAHLDQINEEAGPKVALNSDKWIEFKLQDTARVSHNTQLFRFSFDPTAKLGLDIASCILTRAPTGQDAEGKPKYVIRPYTPISDPDAKGYFDLLIKVYPEGKMSQHFASLKPGDVVEVKGPIEKLRYSPNMKKHIGMIAGGTGITPMLQVIEAILKNSDDNTQVSLLYANVSPDDILLKQKLDVLATSHPNLKVFYTVDNPSKSWRGGTGYISKDMAIKGLPGPSGDTLILVCGPPGMMKHISGDKAKDYSQGELTGLLKELGYTEQMVYKF

SEQ ID NO: 6671 - protein, 328 aa, Citrus clementina
MATTFFRRLAKATPIAFNEAFGGQPKSDFNKFRFPFGAIAAVAGGVSYYCYFSSPNLVHLDQINEETGPKIALNPDKWIGFKLQDTARVSHNSHLFRFSFDPSAKLGLDVASCILTRAPLGQDAEGNTKYVVRPYTPISDTEAKGHFDLLIKVYPEGKMSQHFASLKPGDVVEVKGPIEKLRYSPNMKKHIGMIAGGTGITPMLQVIEAILKNPDDNTQVSLLYGNISPDDILLKQKLDILAASHPNLKVFYTVDNPTQNWKGGVGYISKDTALKGLPRPSDDALILVCGPPGMMKHVSGEKAKDYSQGELSGILKDLGYTEQMVYKF

SEQ ID NO: 6672 - protein, 328 aa, Citrus sinensis
MATTFFRRLVKATPIAFNEAFGGQPKSDFNKFRFPFGAIAAVAGGVSYYCYFSSPNLVHLDQINEETDPKIALNPDKWIGFKLQDTARVSHNSHLFRFSFDPSAKLGLDVASCILTRAPLGQDAEGNTKYVVRPYTPISDTEAKGHFDLLIKVYPEGKMSQHFASLKPGDVVEVKGPIEKLRYSPNMKKHIGMIAGGTGITPMLQVIEAILKNPDDNTQVSLLYGNISPDDILLKQKLDILAASHPNLKVFYTVDNPTKNWKGGVGYISKDTALKGLPSPSDDALILVCGPPGMMKHVSGEKAKDYSQGELSGILKDLGYTEQMVYKF

SEQ ID NO: 6673 - protein, 332 aa, Castanea mollissima
MATFFFKRLARATPIALNNALSFGGANKTKSGFSGFRIPIGTIAAVSGGISYYYCFSSSNLAHLDQINEEAGPKVALNPDKWIEFKLQDTARVSHNTQLFRFSFDPAAKLGLDIASCLLTRAPTGQDAEGKPKYVIRPYTPISDPDAKGYFDLLIKVYPEGKMSQHFASLKPGDVVEVKGPIEKLRYSPNMKKHIGMIAGGTGITPMLQVIEAILKNSDDNTQVSLLYANVSPDDILLKQKLDVLATSHPNLKVFYTVDNPSKSWRGGTGYISKDMAVKGLPGPSDDTLILVCGPPGMMKHISGDKAKDYSQGELTGLLKELGYTEQMVYKF

SEQ ID NO: 6674 - protein, 324 aa, Manihot esculenta
MASTFIRRLAKAAPIGYWGQPKSNYGGFRIPFGAIAAVSGGISYLYYYSSPNLAYLDQVKEGDAQKVALKSNKWIEFKLQDTARVSHNTQLFRFSFDPSAKLGLDIASCILTRAPLGQDAEGKTKYVIRPYTPISDPDAKGYFDLLIKVYPEGKMSQHFASLKPGDVVEVKGPIEKLSYSPNMKKHIGMIAGGTGITPMLQIIEAILKNPDDNTQVSLLYANISPDDILLKQKLDFLAASHSNLKVFYTVDNPSKNWKGGVGYISKDMVLKGLPSPSDDTLILVCGPPGMMKHISGDKAKDYSQGELTGILKELGYAEQMVYKF

SEQ ID NO: 6675 - protein, 324 aa, Malus domestica
MATFFQRLAKAAPTAFNSSFRGQSKSSFRIPFGAVAAVSGGISYLCYYSSPDLVYLDEIKEQTGPKVALNPDKWIEFKLQDTARVSHNTQLFRFTFDPNAKLGLYVASCLLTRAPLGQDAEGKPKYVIRPYTPISDPDAKGYFDLLIKVYPEGKMSQHFASLKPGDVVEVKGPIEKLRYTPNMKKHIGMIAGGTGITPMLQVIEAILKNPDDTTQVSLLYANVSPDDILLKQKLDILAASHPNLKVFYTVDNPTKSWKGGKGYISKDMAVKGLPAPGEDTLILVCGPPGMMKHISGDKAQDRSQGELTGILKELGYTEKMVYKF

SEQ ID NO: 6676 - protein, 324 aa, Manihot esculenta
MASTFFRRLAKAVPTGFGGQLKSNYGAFRIPFGAIAAVSGGISYLYYYSSPNLAYLDQVKEETGPKVALKPDKWIEFKLQDTARVSHNTHLFRFSFDPSAKLGLDIASCILTRAPLELDAEGKTKYVIRPYTPISDPDAKGHFDLLIKVYPEGKMSQHFASLKPGDAIEIKGPIEKLRYSPNMKKHIGMVAGGTGITPMLQVIEAILKNPNDNTQVSLLYANISPDDILLKQKLDFLAASHPNFKVFYTVDNPSKNWKGGTGYISKDMVVKGLPGPSNDALILVCGPPGMMKHISGNKAEDYSQGELTGILKELGYTEQMVYKF

SEQ ID NO: 6677 - protein, 317 aa, Populus trichocarpa
MASTFFRRLSKATPVSFGGQPKSTFGAIAAVTGGISYLYYYNSPNLAHLEEVKVEGSPKVALNPDKWIEFKLQDTARVSHNTHLFRFSFDPAAKLGLDIASCIITRAPIGQDAEGKTKYVVRPYTPISDPDSKGYFDLLIKVYPEGKMSQHFATLKSGDVVEVKGPIEKLRYSPNMKKHIGMIAGGTGITPMLQVIEAILKNPDDNTQVSLLYANVSPDDILLKQKLDFLAASHPNLKIFYTVDNPSKNWKGGSGFISKDMVVKGLPGPCDDTLILVCGPPGMMKHISGDKAKDRSQGELTGLLKEAGYTEEMVYKF

SEQ ID NO: 6678 - protein, 353 aa, Tripterygium wilfordii
PPFLVFWGIGESLAVFVLCFSIENGRNFLQETRLKDQLPIAFNNAFGGQSSSSFTGFRVPFGAMAAVSGGISYFYYFSSPNLVHLDQINEQPGPKIALSPDKWVEFKLQDTARVSHNSQLFRFSFDPTAKLGLDIASCILTRAPTELDPEGKTKYVIRPYTPISDPDAKGYFDLLIKVYPEGKMSQHFASLKPGDVVEVKGPIEKLRYSPNMKKHIGMIAGGTGITPMLQVVEAILKNPDDNTRVSLLYANVSPDDILLKQKLDSLAASHPNFKVFYTVDNPSKNWRGGAGYISKDMVVKGLPSPSDDTLILVCGPPGMMKHVCGDKAKDWSQGELTGTLKEVGYTEQMVYKF

SEQ ID NO: 6679 - protein, 328 aa, Euonymus alatus
MATTFFKRLAKATPIAFNNAFGGQSSSRFTGFRVPFGAMAAVSGGISYFYYFSSPNLVHLDQINEQPGPKIALNPDKWVEFKLQDTARVSHNSQLFRFSFDPTAKLGLGIASCILTRAPIEPDPEGKVKYVIRPYTPISDPDAKGYFDLLIKVYPEGQMSQYFASLKPGDVVEVKGPIEKLKYSPNMKKHIGMIAGGTGITPMLQVVEAILKNPDDNTQVSLLYANVSPDDILLKQKLDLLAASHPNFKVFYTVDNPSKNWKGGIGYLSKDMVVKGLPSPSDDTLILVCGPPGMMKHVSGDKAKDWSQGEVTGTLKEVGYTEQMVYKF

SEQ ID NO: 6680 - protein, 324 aa, Euphorbia peplus
MASTFFRRLAKSTPLAFAGQAKSNYGGFRIPFGAIAAASGGISYLYYYSSPNLAHLDEIKQETGPKSALNPDKWIEFKLQDTARVSHNTHLFRFSFDPSAKLGLDIASCILTRAPLGQDTEGKTKYVIRPYTPISDPDAKGYFDLLIKVYPEGKMSQHFASLKPGDFVEVKGPIEKLRYSPNMKKHIGMIAGGSGITPMLQVIEAILKNPDDNTQVSLLYANVSPDDILLKQKLDSLATSYPNFKVFYTVDNPSKNWKGGVGYISKDIALKGLPRPSDDTLIMVCGPPGMMKQISGEKAKDYSQGEVDGILKDLGYTEQMVYKF

SEQ ID NO: 6681 - protein, 324 aa, Prunus persica
MTAFFQRLAKAAPIAFNNSFGGQSKSSFRIPFGALAAVSGGISYLCYYSSPDLVYLDEIKEQAGPKVALNPNKWIEFKLQDTARVSHNTQLFRFTFDPTAKLGLDVASCLITRAPIEQDAEGKPKYVIRPYTPISDPDSKGYFDLLIKVYPEGKMSQHFASLKPGDVVEVKGPIEKFRYTPNMKKHIGMIAGGSGITPMLQVIEAIMKNPDDTTQVSLLYANVSPDDILLKQKLDILAASHPNLKVYYTVDNPTKSWKGGKGYISKDMAVKGLPGPAEDTLILVCGPPGLMKHISGDKAKDWSQGELTGILKELGYTEEMVYKF

SEQ ID NO: 6682 - protein, 324 aa, Ricinus communis
MASMFFKRLAKASSIGFGGQSKSNFNGFRIPIGAIAAASGGISYLYYYSSPNLAYLDEVKEDAGPKVALKPDKWIEFKLQDTARVSHNTQLFRFSFDPSAKLGLDIASCILTRAPLGHDAEGKTKYVIRPYTPISDPDAKGYFDLLIKVYPEGKMSQHFASLKPGDVVEVKGPIEKLRYSPNMKKHIGMIAGGSGITPMLQIIEAILKNPDDNTQVTLLYGNISPDDILLQQKLDFLAASHPNFKVFYTVENPSKNWKGGVGYVSKDMALKGLPGPSNDTLILVCGPSGMMEHISGSKAKDYSQGELTGLLKELGYTEQMVYKF

SEQ ID NO: 6683 - protein, 326 aa, Vitis vinifera
MALFFKRLAKASPVAFTNAFGGQPKSGARNFRIPFGAIAAVSGGISYYCFSSENLVHLDQINENAGPKVALNPDKWLEFKLQDTASVSHNTQLFRFSFDPTAKLGLDIASCILTRAPIGQDDEGKIKYVIRPYTPISDPDSKGYFDLLIKVYPEGKMSQHFSHLKPGDIIEVKGPIEKLRYTPNMKKQIGMIAGGTGITPMLQIIEAILKNPDDKTQVSLIYANVSPDDILLKKKLDMLAATHPNFKIFYTVDNPSNNWRGGTGYVSKDMVVKGLPAPSDDSLILVCGPPGMMKHISGNKAKDYSQGELTGILKELGYTEDMVYKF

SEQ ID NO: 6684 - protein, 268 aa, Amsonia hubrichtii
MSSKMIRVQRLHSILISGLNLSCKTRHRSSHNTQLFRFQFDPSAKLGLDIASCLLTRAPNGQNAEGKTKYVIRPYTPISDPDAKGYFDLMIKVYPEGKMSQHFASLKPGDVVEVKGPIEKLRYKPNMKKHIGMIAGGTGITPMLQVIEAILKNPDDNTQVSLLYANVSPDDILLKKKLDVLAASHPNLKIFYTVDNPTNDWTGGKGYISKDMAVKGLPEPGDDTLILVCGPPGMMKQISGDKAKDYSQGELTGILKELGYTESMVYKF

SEQ ID NO: 6685 - protein, 331 aa, Gossypium hirsutum
MASCFQCEALPGSPVTTVRVGKTAIPITSLKKKKGLNDHNVVIKCAEIQTAISEGATSFLFTEYQYVGIFMVAFAILIFLFLGSVEGFSTKSQPCTYDKSKMCKPALATAIFSTVSFLLGAVTSVVSGFLGMKIATYANARTTLEARKGVGKAFITAFRSGAVMGFLLAANGLLVLYIAINLFKLYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGINHELTPMLYPLIISSVGIIVCLITTLFATDFFEIKAVKEMSHH

SEQ ID NO: 6686 - protein, 768 aa, Populus trichocarpa
MVSVILPDLGTEILIPVCAIIGIGFSLLQWLLVSKVKLVPSPAASNNSGAAGKNGYGDYLIEEEEGLNDHNVVLKCAEIQNAISEGATSFLFTEYQYVGIFMVAFAILIFVFLGSVEGFSTKSQPCTYDLLKMCKPALATAGFSTVAFVLGAVTSVVSGFLGMKIATYANARTTLEARKGVGKAFIIAFRSGAVMGFLLAANGLLVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLIVSSVGIIICLITTLFATDFFEIKAVKEIEPALKNQLIISTILMTVGVAIVSWVALPSSFTIFNFGTQKVVKNWQLFLCVAVGLWAGLIIGFVTEYYTSNAYSPVQDVADSCRTGAATNVIFGLALGYKSVIIPIFAIAASIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARSLGPKGSDPHKAAVIGDTIGDPLKDTSGPSLNILIKLMAVESLVFAPFFATHGGLLFKIF

SEQ ID NO: 6687 - protein, 768 aa, Populus trichocarpa
MGSPILPDLGTEILIPVCAIIGIGFSLFQWLLVSKVKLTPGSAASNNSGGAGKNGHGDYLIEEEEGLNDHNIVLKCAEIQNAISEGATSFLFTEYQYVGIFMVAFAILIFVFLGSVEGFSTKSQPCTYDPLKLCKPALATAGFSTIAFVLGAVTSVVSGFLGMKIATYANARTTLEARKGVGKAFITAFRSGAVMGFLLAANGLLVLYIAINLFKLYYGDDWEGLFEAITGYGLGGSSMALFGRVAGGIYTKAADVGADLVGKVERNIPEDDPRNPAVIADNVGDNVGDIAGMGSDLFGSYAESSCAALVVASISSFGINHEFTPMLYPLIVSSVGIIVCLLTTLFATDFFEIKAVNEIEPALKNQLIISTVLMTIGVAIVSWIALPSSFTIFNFGTQKVVKNWQLFLCVAVGLWAGLVIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVCRQFNTIPGLMEGTAKPDYATCVKISTDASIKEMIAPGALVMLTPLIVGIFFGVETLSGVLAGSLVSGVQIAISASNTGGAWDNAKKYIEAGVSEHARSLGPKGSDPHKAAVIGDTIGDPLKDTSGPSLNILIKLMAVESLVFAPFFATHGGLLFKIF

SEQ ID NO: 6688 - protein, 769 aa, Manihot esculenta
MGGVILPDIGAEILIPLCAIIGIGFSLFQWLLVSKVKLVPGGRDAAAGNNGVRKNGYNDYLIEEEEGLNDHNVVLKCADIQSAISEGATSFLLTEYKYVGVFMIAFAILIFLFLGSVEGFSTKAQPCTYDPLKTCKPALATAVFSTVSFLLGAITSVISGFLGMKIATYANARTTLEARKGVGKAFITAFRSGAVMGFLLAANGLLVLFIAINLFKIYYGDDWAGLFEAITGYGLGGSSMALFGRVGGGIYTKAADVGADLVGKVERNIPEDDPRNPAVIADNVGDNVGDIAGMGSDLFGSYAESSCAALVVASISSFGIDHELTPMLYPLIISSVGILVCLLTTLFATDFFEIKAVKEIEPALKKQLIISTVLMTVGIAIVSWIALPSSFTIFNFGTQKVVKNWQLFLCVAVGLWAGLIIGFVTEYYTSNAYSPVQDVADSCRTGAATNVIFGLALGYKSVIIPIFAIAVSIFVSFTFAAMYGIAVAALGMLSTIATGLAIDAYGPISDNAGGIAEMAGMSHRIRERTDALDAAGNTTAAIGKGFAIGSAALVSLALFGAFVSRASISIVDVLTPKVFIGLIVGAMLPYWFSAMTMKSVGSAALKMVEEVRRQFNTIPGLMEGTTKPDYATCVKISTDASIKEMIPPGALVMLTPLIVGIFFGVETLSGVLAGSLVSGVQIAISASNTGGAWDNAKKYIEAGASEHARTLGPKGSDAHKAAVIGDTIGDPLKDTSGPSLNILIKLMAVESLVFAPFFATHGGLLFKIL

SEQ ID NO: 6689 - protein, 768 aa, Eucalyptus grandis
MATTILSDLGAEILIPVCAVVGIVFSLVQWLLVSKVKLTPADAAAAPAANNGKNGYTDYLIDEEENINDHSVVLKCAEIQTAISEGATSFLFTEYQYVGVFMVAFAVLIFLFLGSVEGFSMKSQPCTYDATKLCKPALATAVFSTVAFLLGGITSVVSGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGINHELTAMLYPLIVSSVGILVCLVTTLFATDFFEIKAVKEIEPALKKQLIISTVLMTVGIAVVTWISVPSSFTIFNFGTQKVVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAHIVTVDVLTPKVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 6690 - protein, 767 aa, Unknown
  Sequence found in Organisms: Solanum tuberosum, Solanum phureja
MGSALLPDLGTEIVIPVCAVVGIVFSLFQWYLVSRVKVSSERGATSPSNNNKNGYGDYLIEEEEGINDQNVVAKCAEIQNAISEGATSFLFTEYQYVGIFMIAFAILIFLFLGSVEGFSTKGQPCTYNKEKMCKPALATAIFSTISFLLGAVTSVISGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIEHDFTSMCYPLLISSMGILVCLITTLFATDFFEIKAVKEIEPALKNQLIISTVLMTIGIAIVTWTCLPSSFTIFNFGTQKVVKNWELFLCVAVGLWAGLIIGFVTEYYTSNAYSPVQDVADSCRTGAATNVIFGLALGYKSVIIPIFAIAIAIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGLAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGILFKIF

SEQ ID NO: 6691 - protein, 768 aa, Cucurbita pepo
MSVTILPDLGTEIFIPVCAVIGIVFSLVQWYYVSQVKLSPGRDAAHNNSAGSKNGYSDYLIEEEEGVNDHNVVIKCAEIQSAISEGATSFLFTEYKYVGIFMVLFAVLIFVFLGSVESFSTKPQPCTYDKTRTCKPALATAIFSTVSFLLGAVTSVVSGFLGMKIATYANARTTLEARKGVGKAFITAFRSGAVMGFLLAANGLLVLFIAINLFKLYYGDDWGGLFESITGYGLGGSSMALFGRVGGGIYTKAADVGADLVGKVERNIPEDDPRNPAVIADNVGDNVGDIAGMGSDLFGSYAESSCAALVVASISPFGNNHELTPMLYPLIVSSMGILVCLITTLFATDFFEIKAVKEIEPALKKQLIISTVLMTFGIAIVTWLSVPSSFTIFNFGTQKVVTNWKLFLCVAVGLWAGLIIGFVTEYYTSNAYSPVQDVADSCRTGAATNVIFGLALGYKSVIIPIFAIAVSIFVSFTFAAMYGIAVAALGMLSTIATGLAIDAYGPISDNAGGIAEMAGMSHRIRERTDALDAAGNTTAAIGKGFAIGSAALVSLALFGAFVSRAGVTAVDVLTPKVFIGLIVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGASEHARTLGPKGSDPHKAAVIGDTIGDPLKDTSGPSLNILIKLMAVESLVFAPFFASHGGLLFKIF

SEQ ID NO: 6692 - protein, 769 aa, Hevea brasiliensis
MGTAVLSELGTEILVPVCAVVGIVFSLIQWYLVSRVKLTPERQAPGSSPAGANKNGYNDCLIEEEEGLNDHSVVAKCAEIRTAISEGATSFLFTEYQYVGVFMVAFAILIFLFLGSVEGFSTKSQPCTYDKQKTCKPALATAIFSTVSFLLGAFTSVVSGFLGMKIATYANARTTLEARKGVGKAFITAFRSGAVMGFLLAANGLLVLYIAINLFKLYYGEDWEGLFESITGYGLGGSSMALFGRVGGGIYTKAADVGADLVGKVERNIPEDDPRNPAVIADNVGDNVGDIAGMGSDLFGSYAESSCAALVVVPISSFGINHDFTAMLYPLLISSVGILVCLITTLFATDFFEIKAVKEIEPALKKQLIISTVLMTVGIAIVTWIGLPSSFTIFNFGTQKVVKNWQLFLCVAVGLWAGLIIGFVTEYYTSNAYSPVQDVADSCRTGAATNVIFGLALGYKSVIIPIFAIAIGIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLIVGAMLPYWFSAMTMKSVGSAALKMVEEVRRQFNTIPGLMEGHAKPDYATCVKISTDASIKEMIPPGALVMLTPLIVGTFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGLLFKMF

SEQ ID NO: 6693 - protein, 767 aa, Solanum lycopersicum
MGSALLPDLGTEIVIPVCAVVGIVFSLYQWYVVSRVKVSSERGDTSPSNNNKNGYGDYLIEEEEGVNDQNVVAKCADIQNAISEGATSFLFTEYQYVGIFMIAFAILIFLFLGSVEGFSTKSQPCTYNKEKMCKPALATAIFSTISFLLGAITSVISGFLGMKIATYANARTTLEARKGVGKAFIVAFRSGAVMGFLLAANGLLVLHITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIEHDFTSMCYPLLISSMGILVCLITTLFATDFFEIKAVKEIEPALKHQLIISTALMTIGIAIVTWTCLPSSFTIFNFGTQKVVKNWELFLCVAVGLWAGLIIGFVTEYYTSNAYSPVQDVADSCRTGAATNVIFGLALGYKSVIIPIFAIAIAIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGHAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGILFKIF

SEQ ID NO: 6694 - protein, 767 aa, Euonymus alatus
MGETAVLSELATEILIPVSAVIGIVFSLVQWFLVSRVKLTPGRHASSANNKKNGYGDYLIEEEEGLDDHSVVTKCAEIQNAISEGATSFLFTEYQYVGIFMVAFAILIFLFLGSVEGFSTKSQPCTYNEHKMCKPALATAVFSTVSFLLGAITSILSGFLGMKIATYANARTTLEARKGVGKAFITAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIDHQFTAMCYPLLISSMGILVCLITTLFATDFFEIKAVKEIEPALKKQLIISTVLMTAGIAIVTWLGLPSSFTIYNFGVQKVVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHHIRERTDALDAAGNTTAAIGKGFAIGSAALVSLALFGAFVSRAALSTVDVLTPKVFIGLLVGAMLPYWFSAMTMKSVGSAALKMVEEVRRQFNTIPGLMEGLAKPDYATCVKISTDASLKEMIPPGALVMLTPLIVGTFFGVETLSGVLAGSLISGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 6695 - protein, 766 aa, Euonymus alatus
MGSGILPDLATEILIPVCAVIGIVFALVQWVIVSRVKLTPGSDSPANSGGKNGYSDYLIEEEEGLNDHNVVLKCAEIQSAISEGATSFLYTEYQYVGIFMVAFAILIFLFLGSVNGFSTKSQTCTYDTQSMCKPALATAAFSTVAFLLGAVTSVVSGFLGMKIATYANARTTLEARKGVGKAFIIAFRSGAVMGFLLAANGLLVLYIVINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDFTAMLYPLIISSVGIVICLITTLFATDFFEVKAVNEIEPALKKQLIISTVLMTVAVAIVTWISVPFSFTIFNFGTQKVVKSWQLFLCVAVGLWAGLIIGFVTEYYTSNAYSPVQDVADSCRTGAATNVIFGLALGYKSVIIPIFAIAVSIFVSFSFAAMYGVAVAALGMLSTIATGLAIDAYGPISDNAGGIAEMAGMSHRIRERTDALDAAGNTTAAIGKGFAIGSAALVSLALFGAFVSRASITTVDVLTPKVFIGLIVGAMLPYWFSAMTMKSVGSAALKMVEEVRRQFNTIPGLMEGTAKPDYANCVKISTDASIKEMIPPGALVMLTPLIVGILFGVETLAGVLAGSLVSGVQVAISASNTGGAWDNAKKYIEAGASEHARTLGPKGSDPHKAAVIGDTIGDPLKDTSGPSLNILIKLMAVESLVFAPFFATHGGILFKIL

SEQ ID NO: 6696 - protein, 761 aa, Tropaeolum majus
MGTVILPDLGTEILIPACAVIGILFSLLQYIKVASVKLSPPRESAEKNGHNDYLLEEEEGLNDHNVVARCAEIQQAISEGATSFLFTEYQYVGIFMVAFAILIFVFLGSVEGFSTKSQPCSYDQVKMCKPALATAAFSTISFLLGAITSVVSGFLGMKIATYANARTTLEARKGVGKAFIVAFRSGAVMGFLLAANGLLVLYITINLFKIYYGDDWSGLFESITGYGLGGSSMALFGRVGGGIYTKAADVGADLVGKVERNIPEDDPRNPAVIADNVGDNVGDIAGMGSDLFGSYAEASCAALVVASISSFGINHEFTSMLYPLIISSVGIIVCLITTLFATDFFEIKAVSEIEPSLKRQLIISTVLMTIGIAIVSWVALPPSFTIFNFGTQKVVKNWELFLCVAVGLWAGLIIGFVTEYYTSNAYSPVQDVADSCRTGAATNVIFGLALGYKSVIIPIFAIAVSIFVSFTFAAMYGVAVAALGMLSTIATGLAIDAYGPISDNAGGIAEMAGMSHRIRERTDALDAAGNTTAAIGKGFAIGSAALVSLALFGAFVSRAGISTVDVLTPKVIIGLLVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGVSEHARSLGPKGSDPHKAAVIGDTIGDPLKDTSGPSLNILIKLMAVESLVFAPFFATHGGLLLKL

SEQ ID NO: 6697 - protein, 769 aa, Catharanthus roseus
MGAAILPDLGTEILIPACAVVGIVFALFQWILVSKVKLSSDKHHSSAAAASDGKNGFTEALIEEEEGINEHSVVQKCADIQNAISEGATSFLFTEYQYVGVFMVAFAILIFVFLGSVEGFSTKGRTCTYDTSKICKPALATAGFSTVSFLLGAVTSVLSGFLGMKIATYANARTTLEARKGVGKAFITAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDLTAMLYPLLISSVGIIVCLITTLFATDFFEVKDVKQIEPALKRQLIISTILMTVGIAIVSLVGLPSSFTIFNFGVQKEVRNWQLFLCVAVGLWAGLIIGFVTEYYTSNAYSPVQDVADSCRTGAATNVIFGLALGYKSVIIPIFAIAVSIFVSFTFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGSLVSGVQIAISASNTGGAWDNAKKYIEAGASEHARTLGPKGSDAHKAAVIGDTIGDPLKDTSGPSLNILIKLMAVESLVFAPFFATHGGLLFKIF

SEQ ID NO: 6698 - protein, 764 aa, Tabernaemontana elegans
MASALLPDLATEIVIPVCAVVGIVFSLIQWYLVSRVKLSPERSASSNNNKNGYNDYLIEEEEGINDQNVVVKCAEIQSAISEGATSFLFTEYKYVGLFMVAFAILIFLFLGSVDGFSTKSQPCTYNKEKMCKSALATAIFSTVSFLLGGFTSVVSGFLGMKIATYANARTTLEARKGVGKAFITAFRSGAVMGFLLASNGLLVLYIAINLFKLYYGEDWEGLFEAITGYGLGGSSMALFGRVGGGIYTKAADVGADLVGKVERNIPEDDPRNPAVIADNVGDNVGDIAGMGSDLFGSYAESSCAALVVASISSFGIYHEFTPMLYPLLISSMGILVCLITTLFATDFFEIKAVKEIEPALKKQLIISTALMTVGVAIITWTCLPSSFTIFNFGTQKVVKNWQLFLCVGVGLWSGLIIGFVTEYYTSNAYSPVQDVADSCRTGAATNVIFGLALGYKSVIIPIFAIAISIFVSFSFAAMYGIAMAALGMLSTIATGLAIDAYGPISDNAGGIAEMAGMSHRIRERTDALDAAGNTTAAIGKGFAIGSAALVSLALFGAFVSRAGISTVDVLTPKVFIGLIVGAMLPYWFSAMTMKSVGSAALKMVEEVRRQFNTIPGLMEGQAKPDYATCVKISTDASIKEMIPPGALVMLTPLIVGTLFGVETLAGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKI

SEQ ID NO: 6699 - protein, 767 aa, Malus domestica
MAVLLSTLATEIVIPVAAVVGIVFSLVQWFLVSLVKVTPERNAPPSGPNSNKNGYNDYLIEEEEGLNDQNVVVKCAEIQNAISEGSTSFLFTMYQYVGVFMVVFAILIFLFLGSVEGFSTKSQPCTYDAAKTCKPALATAIFSTVAFVLGGITSVLSGFLGMKIATYANARTTLEARKGVGKAFITAFRSGAVMGFLLAANGLLVLFITINLFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIVCLITTLFATDFFEIKAVKEIEPALKKQLIISTGLMTIGIAIVSWIALPSSFTIFNFGVQKVVKNWQLFLCVAVGLWAGLIIGFVTEYYTSNAYSPVQDVADSCRTGAATNVIFGLALGYKSVIIPIFAIAVSIYVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVILTPLIVGTFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 6700 - protein, 768 aa, Tripterygium wilfordii
MGGTVMLSELATEILIPVCAVIGIVFSLVQWSLVSRVKLTYERHDSSPNNKKNGYGGDYLIEEEEGLNDHSVVTKCAEIQNAISEGATSFLFTEYQYVGIFMVAFAILIFLFLGSVESFSTKSQPCTYNEHKMCKPALATAVFSTVSFLLGAITSVVSGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIDHQFTAMCYPLLISSMGILVCLITTLFATDFFEIKAVKEIEPALKKQLIISTVFMTVGIAVVSWLALPSSFTIYNFGVQKVVKNWQLFLCVGVGLWAGLIIGFVTEYYTSNAYSPVQDVADSCRTGAATNVIFGLALGYKSVIIPIFAIAVSIFVSFSFAAMYGIAMAALGMLSTIATGLAIDAYGPISDNAGGIAEMAGMSHRIRERTDALDAAGNTTAAIGKGFAIGSAALVSLALFGAFASRAAISTVDVLAPKVFIGLIVGAMLPYWFSAMTMKSVGSAALKMVEEVRRQFNTIPGLMEGLAKPDYATCVKISTDASIKEMIPPGALVMLTPLIVGTLFGVETLAGVLAGSLVSGVQIAISASNTGGAWDNAKKYIEAGASEHAKTLGPKGSEPHKAAVIGDTIGDPLKDTSGPSLNILIKLMAVESLVFAPFFATHGGLLFKIF

SEQ ID NO: 6701 - protein, 767 aa, Amsonia hubrichtii
MGEAILPDLGTQILIPVCAVVGIVFALVQWFIVSKVKVSSDKHHSSAAADGKNGFTEALIEEEEGINEHSVVQKCADIQNAISEGATSFLFTEYQYVGVFMVAFAVLIFVFLGSVEGFSTKGRACTFDSSKICKPALATAGFSTVSFLLGAVTSVLSGFLGMKIATYANARTTLEARKGVGKAFITAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGILVCLLTTLFATDFFEVKDVKQIEPALKKQLIISTVLMTIGIAIVSWIGLPTSFTIFNFGVQKEVRNWQLFLCVAVGLWAGLIIGFITEYYTSNAYSPVQDVADSCRTGAATNVIFGLALGYKSVIIPIFAIAVGIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTTKPDYANCVKISTDASIKEMIPPGALVMLTPLIVGIFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 6702 - protein, 767 aa, Lotus japonicus
MGAVLLPDLGTEILIPVCAVIGIVFALFQWFLVSKVKITAATRDAASPDAAGKNGYNDYLIEEEEGINDQNVVLKCAEIQQAISEGATSFLFTEYKYVGIFMVFFAIVIFLFLGSVEGFSTSHQPCKYDETKICKPALATALFSTISFVLGGITSVVSGFLGMKIATYANARTTLEARKGVGKAFITAFRSGAVMGFLLAANGLLVLYITINLFQIYYGEDWGGLFEAITGYGLGGSSMALFGRVAGGIYTKAADVGADLVGKVERNIPEDDPRNPAVIADNVGDNVGDIAGMGSDLFGSYAEASCAALVVASISSFGINHEFTAMLYPLIVSSVGIVVCLITTLFATDIFEIKLVKEIEPALKKQLIISTVLMTVGIAIVSWIALPSSFTIFNFGVQKDVKNWQLFLCVAVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRANITTVDVLTPKVFIGLIVGAMLPYWFSAMTMKSVGKAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARSLGPKGSDCHKAAVIGDTIGDPLKDTSGPSLNILIKLMAVESLVFAPFFATHGGLLFKI

SEQ ID NO: 6703 - protein, 767 aa, Solanum lycopersicum
MGSALLSEFGTEIVIPICAVIGIVFSLVQWYLVSLVKLSPEQGGCSPRNNKNNGFNESLVEEEEGINDQNVVVKCAEIQNAISEGATSFLFTEYQYVGIFMVAFAVLIFVFLGSVEGFSTKSQPCTYNKEKMCKPALATAIFSTISFLLGAVTSVVSGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIDHDFTAMCYPLLISSMGILVCLITTLFATDFFEIKAVKEIEPALKHQLIISTALMTVGIAIVTWTCLPSSFTIFNFGTQKVVKNWQLFLCVAIGLWAGLIIGFVTEYYTSNAYSPVQDVADSCRTGAATNVIFGLALGYKSVIIPIFAIAVAIFVSFTFAAMYGIAVAALGMLSTIATGLAIDAYGPISDNAGGIAEMAGMSHRIRERTDALDAAGNTTAAIGKGFAIGSAALVSLALFGAFVSRASISTVDVLTPEVFIGLIVGAMLPYWFSAMTMKSVGSAALKMVEEVRRQFNTIPGLMEGLAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGILFKIF

SEQ ID NO: 6704 - protein, 765 aa, Fragaria vesca
MGASILPDLGAEILIPFCAVVGIVFSLLQWVYVSRVQLSPARDSNSNSTGKNGYNDYLIEEEEGVNDNNVVQKCAEIQNAISEGATSFLYTEYKYVGAFMVAFAILIFVFLGSVEGFSTSGHKCANDETKMCKPALATALFSTVSFLLGAITSVVSGFLGMKIATYANARTTLEARKGVGKAFIVAFRSGAVMGFLLAANGLLVLYIVILVFKMYYGEDWGGLFESITGYGLGGSSMALFGRVGGGIYTKAADVGADLVGKVERNIPEDDPRNPAVIADNVGDNVGDIAGMGSDLFGSYAESSCAALVVASISSFGINHELTAMLYPLIVSSIGIIVCLITTLFATDFFEIKAVKEIEPALKRQLIISTVLMTVGVAIVTWISVPSSFTIFNFGTQKVVKNWQLFLCVCVGLWAGLIIGFVTEYYTSNAYSPVQDVADSCRTGAATNVIFGLALGYKSVIIPIFAIAISIYVSFSFAAMYGIAIAALGMLSTIATGLAIDAYGPISDNAGGIAEMAGMSHRIRERTDALDAAGNTTAAIGKGFAIGSAALVSLALFGAFVSRAGIATVDVLTPKVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARSLGPKGSDPHKAAVIGDTVGDPLKDTSGPSLNILIKLMAVESLVFAPFFATHGGLLFKL

SEQ ID NO: 6705 - protein, 765 aa, Aquilegia formosa
MGATIISDLVTEIVIPVCAVIGILFSLLQWYLVSQVKLSPDRQQSPKNNKSGFNDYLIEEEEGLNDNNVVIKCAEIQQAISEGATSFLFTEYQYVGIFMVAFAVLIFLFLGSVEGFSTKSQPCTYNKHEMCKSALANALFSTISFVLGAITSVVSGFLGMKIATYANARTTLEARKGVGKAFITAFRSGAVMGFLLAASGLLVLFITINCFKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGINHEYTAMLYPLLISSMGILVCLLTTLFATDFFEIKAVKEIEPALKNQLIISTALMTVGIALVTWLALPSSFTIFNFGEQKVVKNWELFFCVAIGLWAGLVIGFVTEYYTSNAYSPVQDVADSCRTGAATNVIFGLALGYKSVIIPIFAIAVSIFVSFSLAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVMLTPLIVGTFFGVETLSGVLAGSLVSGVQIAISASNTGGAWDNAKKYIEAGASEHARSLGPKGSDPHKAAVIGDTIGDPLKDTSGPSLNILIKLMAVESLVFAPFFAKHGGLLFKIF

SEQ ID NO: 6706 - protein, 765 aa, Vinca minor
MTSALLPDLGTQIVIPVCAIIGIVFSLIQWVLVSRVKLSPERNSSTNKNKDGYNDYLIEEEEGINDHNVVAKCAEIQSAISEGATSFLFTEYKYVGFFMAAFAILIFLFLGSVEGFSTKSQPCTYNKEETCKPALATAVFSTLSFVLGAVTSVVSGFLGMKIATYANARTTLEARKGVGKAFIVAFRSGAVMGFLLAANGLLVLYIVINVFKLYYGSDWEGLFEAITGYGLGGSSMALFGRVGGGIYTKAADVGADLVGKVERNIPEDDPRNPAVIADNVGDNVGDIAGMGSDLFGSYAESSCAALVVASISSFGIDHDFTAMLYPLLISSMGIIVCLITTLFATDFFEIKTVEEIEPALKKQLIISTVLMTVGVAIVTWTCLPSSFTIFNFGTQKVVKNWQLFLCVGVGLWAGLIIGFVTEYYTSNAYSPVQDVADSCRTGAATNVIFGLALGYKSVIIPIFAIAISIFVSFTFAAMYGIAMAALGMLSTIATGLAIDAYGPISDNAGGIAEMAGMSHRIRERTDALDAAGNTTAAIGKGFAIGSAALVSLALFGAFVSRASISTVDVLTPKVFIGLIVGAMLPYWFSAMTMKSVGSAALKMVEEVRRQFNTIPGLMEGTAKPDYATCVKISTDASLKEMVPPGALVMLTPLIVGTFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKLW

SEQ ID NO: 6707 - protein, 768 aa, Vinca minor
MGEAILPDLGTQILIPACAVVGIVFALIQWVIVSKVKLSSDKNHSSTAADDGKNGFTEALIEEEEGINEHSVVQKCAEIQTAISEGATSFLFTEYQYVGVFMVIFAILIFVFLGSVEGFSTKGRACTYDSTKMCKPALATAGFSTLSFLLGAVTSVLSGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKLERNIPEDDPRNPAVIADNVGDNVGDIAGMGSDLFGSYAESSCAALVVASISSFGINHDFTAMLYPLVISSVGIIVCLITTLFATDFFEVKDVKQIEPALKKQLIISTALMTVGIAIVSWIGLPSSFTIFNFGVQKEVQNWQLFLCVAVGLWAGLIIGFVTEYYTSNAYSPVQDVADSCRTGAATNVIFGLALGYKSVIIPIFAIAVGIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLLVGAMLPYWFSAMTLKSVGSAALKMVEEVRRQFNTIPGLMEGTTKPDYATCVKISTDASIKEMIPPGALVMLTPLIVGIFFGVETLSGILAGSLVSGVQIAISASNTGGAWDNAKKYIEAGASEHARTLGPKGSDCHKAAVIGDTVGDPLKDTSGPSLNILIKLMAVESLVFAPFFATHGGLLFKIF

SEQ ID NO: 6708 - protein, 769 aa, Cleome gynandra
MVTATMLSEMGTEILVPVCAVIGIVFSLVQWFLVSRVKLTADRSTASGGANNGKNGYGDYLIEEEEGVNDQSVVTKCAEIQNAISEGATSFLFTEYKYVGAFMVGFAILIFIFLGSVEGFSRESQPCTYDKTRTCKPALATAAFSTVSFLLGAVTSLLSGFLGMKIATYANARTTLEARKGVGKAFITAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGLNHDFTAMCYPLLISSMGILVCLITTLFATDFFEIKAVKEIEPALKWQLIISTAIMTIGIAIVTWVGLPSSFTIYNFGTQKVVKNWQLFLCVGVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAEIQTVDVLTPKVFIGLLVGAMLPYWFSAMTMKSVGSAALKMVEEVRRQFNTIPGLMEGTAKPDYATCVKISTDASIKEMLPPGALVMLTPLIVGTLFGVETLSGVLAGSLVSGVQIAISASNTGGAWDNAKKYIEAGVSEHARSLGPKGSEPHKAAVIGDTIGDPLKDTSGPSLNILIKLMAVESLVFAPFFATHGGILFKIF

SEQ ID NO: 6709 - protein, 767 aa, Prunus persica
MAVLLSTLATEIVIPVAAVIGIVFSLVQWFIVSRVKVTPERHAPPPGPNSNKNGFNDYLIEEEEGLHDQNVVAKCAEIQNAISEGATSFLFTEYQYVGVFMVVFAILIFLFLGSVEGFSTKSQPCTYDAQRTCKPALATAIFSTVAFVLGGVTSILSGFLGMKIATYANARTTLEARKGVGKAFIVAFRSGAVMGFLLAANGLLVLYITINVFKVYYGDDWEGLFESITGYGLGGSAMALFGRVGGGIYTKAADVGADLVGKVERNIPEDDPRNPAVIADNVGDNVGDIAGMGSDLFGSYAESSCAALVVASISSFGINHEFTSMLYPLLISSMGILICLITTLFATDFFEIKAVKEIEPALKKQLIISTVLMTVGIAIISWIALPSSFTIYNFGVQKVVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVILTPLIVGTLFGVETLSGVLAGSLVSGVQVAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 6710 - protein, 764 aa, Catharanthus roseus
MTSALLPDLGTEIVIPVCAVIGIVFSLIQWVLVSRVKLSPERNATNNNNKNGYNDYLIEEEEGINDQNVVVKCAEIQNAISEGATSFLFTEYKYVGIFMVAFAILIFLFLGSVEGFSTKSQPCTYDKEKMCKPALATAVFSTVSFLLGAVTSVLSGFLGMKIATYANARTTLEARKGVGKAFIIAFRSGAVMGFLLAANGLLVLYIAINLFKLYYGSDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDFTAMLYPLLVSSMGILVCLITTLFATDFFEIKAVKEIEPALKKQLIISTILMTVGVAIVTWTCLPSSFTIFNFGTQKVVKNWQLFLCVGVGLWAGLIIGFVTEYYTSNAYSPVQDVADSCRTGAATNVIFGLALGYKSVIIPIFAIAISIFVSFTFAAMYGIAMAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVMLTPLIVGTFFGVETLSGVLAGSLVSGVQIAISASNTGGAWDNAKKYIEAGASEHARTLGPKGSEPHKAAVIGDTIGDPLKDTSGPSLNILIKLMAVESLVLLPSLQLMVVCSSRY

SEQ ID NO: 6711 - protein, 764 aa, Nicotiana tabacum
MGSALLPDLGTQIVIPVCAVIGIVFSSFQWYLVSRVKVSSEHGATSPSSNKNNKNGYGDCLIEEEEGINDHNVVAKCADIQNAISEGATSFLFTEYQYVGIFMIAFAILIFLFLGSVEGFSTSSQPCTYNKEKRCKPALATAIFSTVSFLLGAITSVISGFLGMKIATYANARTTLEARKGVGKACLVQVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIDHDFTAMCYPLLISSMGILVCLITTLFATDFFEIKAVKEIEPALKNQLIISTAIMTVGIAIVTWTCLPSSFTIFNFGTQKVVKNWQLFLCVAVGLWAGLIIGFVTEYYTSNAYSPVQDVADSCSTGAATNVIFGLALGYKSVIIPIFAIAIAIFVSFTFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPQVFIGLIVGAMLPYWFSAMTMKSVGSAALKMVEEVRRQFNTIPGLMEGLAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGILFKIF

SEQ ID NO: 6712 - protein, 768 aa, Vinca minor
MGAAILPDLGTEILIPACAVVGIVFSLIQWFLVSKVKVSSSDKHQAAGTADGKNGFTEALIEEEEGINEHSVVQKCADIQNAISEGATSFLFTEYQYVGVFMVIFAILIFVFLGSVEGFSTKGRACTYDSTKICKPALATAGFSTLSFLLGAVTSVISGFLGMKIATYANARTTLEARKGVGKAFVVAFRSGAVMGFLLVANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSFAESSCAALVVASISSFGINHDLTAMLYPLLISSVGIIVCLITTLFATDFFEIKDVKQIEPALKKQLIISTALMTVGIAIVSWIGLPSSFTIFNFGVQKEVQNWQLFLCVSVGLWAGLIIGFVTEYYTSNAYSPVQDVADSCRTGAATNVIFGLALGYKSVIIPIFAIAVSIFVSFSFAAMYGIAVSALGMLSTLATGLAIDAYGPISDNAGGIAEMAGMSHQIRERTDALDAAGNTTAAIGKGFAIGSAALVSLALFGAFVSRASISTVDVLTPKVFIGLLVGAMLPYWFSAMLMKSVGSAALKMVEEVRRQFNTMPGLMEGTTKPDYATCVKISTDASIKEMIPPGALVMLTPLIVGIFFGVETLSGVLAGSLVSGVQIAISASNTGGAWDNAKKYIEAGASEHARTLGPKGSDAHKAAVIGDTVGDPLKDTSGPSLNILIKLMAVESLVFAPFFATHGGLLFKLF

SEQ ID NO: 6713 - protein, 764 aa, Vitis vinifera
MAILSDLGTEILVPACAIVGIVFSVVQWILVSRVKLSPERHSLSNSSKNGTAEYLIEEEEGLNDHSVVQKCAEIQNAISEGATSFLYTEYQYVGIFMVAFAILIFVFLGSVEGFSTKSQPCLYNKGEMCKPALANAIFSTISFLLGGLTSLLSGFLGMKIATYANARTTLEARKGVGKAFITAFRSGAVMGFLLAANGLLVLYIAINLFEIYYGDDWEGLYEAITGYGLGGSSMALFGRVGGGIYTKAADVGADLVGKVERGIPEDDPRNPAVIADNVGDNVGDIAGMGADLFGSYAESSCAALVVASISSFGINHEMTAMFYPLIISSIGILVCLITTLFATDFFEIKAVKEIEPALKKQLIISTILMTAGIAFVSWIALPSSFTIFNFGSQKVVKNWQLFLCVGVGLWAGLIIGFVTEYYTSNTYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGTLLGVETLAGVLAGSLVSGVQIAISASNTGGAWDNAKKYIEAGASEHAKALGPKGSDPHKAAVIGDTIGDPLKDTSGPSLNILIKLMAVESLVFAPFFAAHGGLLFKIWK

SEQ ID NO: 6714 - protein, 767 aa, Fragaria vesca
MAVLLSYLATEIVIPVCAVVGILFSLLQWYLVSRVRVTPDRNAPAPGTNAKKNGFNDYLIEEEEGVTDQNVVAKCAEIQNAISEGATSFLFTEYQYVGVFMVVFAVLIFLFLGSVKGFSTESQPCTYDVTSTCKPALATALFSTVAFLLGGITSLLSGFLGMKIATYANARTTLEARKGVGKAFIVAFRSGAVMGFLLAANGLLVLYITINLFQLYYGDDWEGLFEAITGYGLGGSAMALFGRVGGGIYTKAADVGADLVGKIERNIPEDDPRNPAVIADNVGDNVGDIAGMGSDLFGSYAESSCAALVVASISSFGINHEFTAMLYPLLVSSMGILICLITTLFATDFFEIKAVKDIEPALKNQLIISTVLMTIGIAIVSWVALPSSFTIYNFGVQKVVKNWQLFLCVSVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGLAKPDYATCVKISTDASIKEMIPPGALVILTPLIVGTLFGVETLSGVLAGSLVSGVQVAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 6715 - protein, 274 aa, Lippia dulcis
MALLPDLGAEIVIPVCAVIGIVSSLVQWFLVSRVKLTGEHGGESPAKNGKNGYSDYLIEEEDGINDQNVVVKCAEIQSAISEGATSFLFTEYQYVGVFMFAFAILIFLFLGSVEGFSTKSQSCTYDKEKMCKPALATAIFSTTSFLLGAVTSLVSGFLGMKIATYANARTTLEARKGVGKAFIVAFRSGAVMGFLLAANGLLILYIAINVFKIYYGDDWEGLFEAITGYGLGGSSMALFGRVGGGIYTKAADVGADLVGKVERTFRKMTLGILL

SEQ ID NO: 6716 - protein, 764 aa, Arnica chamissonis
MATSTILSDLGTQILIPICAVVGILFSLFQWYLVSQVTLSPEKPAADGKNGYKEALIEEEEGINDHTVVQKCAEIQSAISEGATSFLFTMYQYVGVFMVIFAILIFVFLGSVEGFSTSSKICTYDATKTCKPALMTAVFSTVSFLLGAITSVVSGFLGMKIATYANARTTLEARRGVSKAFIVAFRSGAVMGFLLAANGLLVLYITINLFKIYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGNTHDFTPMMYPLIVSSVGILVCLITTLFATDFFEVKTVKQIEPSLKNQLIISTVLMTIGIAIVSWIALPSSFTIFNFGAQKVVKNWQLFLCVGVGLWAGLIIGFVTEYYTSNAYSPVQDVADSCRTGAATNVIFGLALGYKSVIIPIFAIAASIFVSFSFAAMYGVAVAALGMLSTIATGLAIDAYGPISDNAGGIAEMAGMSHRIRERTDALDAAGNTTAAIGKGFAIGSAALVSLALFGAFVSRAEITTVDVLTPKVFIGLLVGAMLPYWFSAMTMKSVGKAALKMVEEVRRQFNTIPGLMEGTAKPDYATCVKISTDASIKEMIAPGALVMLTPLIVGIFFGVETLSGVLAGSLVSGVQIAISASNTGGAWDNAKKYIEAGVSDHAKSLGPKGSDPHKAAVIGDTIGDPLKDTSGPSLNILIKLMAVESLVFAPFFATHGGLLFKFF

SEQ ID NO: 6717 - protein, 764 aa, Arnica chamissonis
MGTTTILSDLGTEIIIPICAVVGIIFSLFQWYLVSQVKLSLEEPAADGKNGFTEALIEEEEGINDHAVVQKCAEIQNAISEGATSFLFTEYQYVGVFMVIFAVVIFVFLGSVEGFSTSSKICTYDTTKMCKPALMTALFSTVSFLLGAITSVVSGFLGMKIATYANARTTLEARKGVGKAFIVAFRSGAVMGFLLAANGLLVLYITINLFKIYYGDDWEGLFESITGYGLGGSSMALFGRVAGGIYTKAADVGADLVGKVERNIPEDDPRNPAVIADNVGDNVGDIAGMGSDLFGSYAESSCAALVVASISSFGTTHDFTPMMYPLIVSSVGILVCLITTLFATDFFEVKTVQQIEPSLKNQLIISTVLMTIGIAIVSWIALPSSFTIFNFGAQKVVKNWQLFLCVCVGLWAGLIIGFVTEYYTSNAYSPVQDVADSCRTGAATNVIFGLALGYKSVIIPIFAIAVSIFVSFSFAAMYGVAVAALGMLSTIATGLAIDAYGPISDNAGGIAEMAGMSHRIRERTDALDAAGNTTAAIGKGFAIGSAALVSLALFGAFVSRAEITTVDVLTPKVFIGLLVGAMLPYWFSAMTMKSVGKAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGVSDHAKSLGPKGSDPHKAAVIGDTVGDPLKDTSGPSLNILIKLMAVESLVFAPFFATHGGLLFKIF

SEQ ID NO: 6718 - protein, 762 aa, Helianthus annuus
MVTSTILSDLGTEILIPACALVGIVFSLLQWFLVSKVSLSLDKPDAKHAFTESLIEEEEGVNDHNVVQKCAEIQNAISEGATSFLFTEYQYVGIFMIAFAVLIFVFLGSVEGFSTSYQQCTYDTTKMCKPALFTAVFSTVSFILGAITSVISGFLGMKIATYANARTTLEARKGVGKAFIVAFRSGAVMGFLLAANGLLVLYITINVFKIYYGDDWEGLFEAITGYGLGGSSMALFGRVGGGIYTKAADVGADLVGKVERNIPEDDPRNPAVIADNVGDNVGVIAGMGSDLFGSYAESSCAALVVASISSFGNNHDFTAMMYPLLISSVGILVCLITTLFATDIFEVKTVKEIEPSLKNQLIISTVLMTIGIALVSWIALPYSFTIFNFGVQKEVKNWQLFLCVGVGLWAGLIIGFVTEYYTSNAYSPVKDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAEITTVDVLTPKVFIGLLVGAMLPYWFSAMTMKSVGKAALSMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARTLGPKGSDAHKAAVIGDTVGDPLKDTSGPSLNILIKLMAVESLVFAPFFATHGGLLFKIF

SEQ ID NO: 6719 - protein, 767 aa, Podocarpus macrophillus
MGGAILSGMLTEILIPVAAVIGIVFALVQWFVVSRVKVQPSHANGASNNSNKNGYSEYLIEEEEGINDQNVVAKCAEIQNAISEGATSFLFTEYQYMGIFMTFFAVIIFLFLGSVEKFSTKSQPCTYSKETMCKPALANAIFSTVSFLLGSLTSAVSGYLGMKIATYANARTTLEARKGVGKAFITAFRSGAVMGFLLAANGLLVLYITLNLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDLTAMCYPLLISSMGIIVCLITTLFATDLFEIKAVKEIEPALKKQLIISTVLMTIGIAVVSFIALPSSFTIFNFGAQKVVKNWQLFFCVAVGLWAGLVIGFVTEYYTSNAYSPVQDVADSCKTGAATNVIFGLALGYKSVIIPIFAIAVSIFVSFSLAAMYGIAVAALGMLSTIATGLAIDAYGPISDNAGGIAEMAGMSHRIRERTDALDAAGNTTAAIGKGFAIGSAALVSLALFGAFVSRAGISTVDVLTPKVFIGLIVGAMLPYWFSAMTMKSVGSAALKMVEEVRRQFNTIPGLMEGHAKPDYATCVKISTDASLREMIPPGCLVMLTPLIVGTLFGVETLSGVLAGALVSGVQVAISASNTGGAWDNAKKYIEAGASEHARTLGPKGSDPHKAAVIGDTIGDPLKDTSGPSLNILIKLMAVESLVFAPFFAAHGGLLFKLL

SEQ ID NO: 6720 - protein, 766 aa, Pinus pinaster
MGGALLSETLTEILIPVAAVIGIGFALIQWVLVSRVKVSPDHSHTPSNNNKNGYSEYLIEEEEGLNDHNVVNKCAEIQNAISEGANSFLFTEYQYMGIFMVCFAALIFLFLGSVEKFSTKSQPCTYNKEVMCKPALANAIFSTIAFLLGSLTSILSGYLGMKIATYANARTTLEARKGVGKAFITAFRSGAVMGFLLAANGLLVLFIAITLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGNSHDLTAMCYPLLISSMGIIACLITTLFATDIFEIKAVKEIEPALKKQLIISTVVMTIGIAVVSLVALPSSFTIFNFGTQKVVKNWELFFCVAIGLWSGLVIGFVTEYYTSNAYSPVQDVADSCRTGAATNVIFGLALGYKSVIIPIFAIAVSIFVSFSLAAMYGIAVAALGMLSTIATGLAIDAYGPISDNAGGIAEMAGMSHRIRERTDALDAAGNTTAAIGKGFAIGSAALVSLALFGAFVSRAAIQTVDVLTPKVFIGLIVGAMLPYWFSAMTMKSVGSAALKMVEEVRRQFNTIPGLMEGHAKPDYGTCVKISTDASLKEMIPPGCLVMLTPLIVGTFFGVETLSGVLAGALVSGVQVAISASNTGGAWDNAKKYIEAGASEHARTLGPKGSDPHKAAVIGDTIGDPLKDTSGPSLNILIKLMAVESLVFAPFFATHGGLLFKFF

SEQ ID NO: 6721 - protein, 765 aa, Lactuca sativa
MGTSTILSDLGTEIIIPICAVVGIIFSLFQWYLVSQVKLSLEKPSADDKNGYTEALIEEEEGINDHTVVQKCAEIQTAISEGATSFLMTEYQYVGIFMVIFAVLIFVFLGSVESFSTSSKVCTYDTTKMCKPALMTAVFSTVSFILGAVTSVISGFLGMKIATYANARTTLEARKGVGKAFIVAFRSGAVMGFLLAANGLLVLYITINLFKIYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHEFTAMMYPLIVSSVGILVCLITTLFATDFFEVKTVKQIEPTLKNQLIISTILMTIGVALVSWVALPSSFTIFNFGTQKVVKNWQLFLCVCVGLWAGLIIGFVTEYYTSNAYSPVQDVADSCRTGAATNVIFGLALGYKSVIIPIFAIAVSIFVSFTFAAMYGVAVAALGMLSTIATGLAIDAYGPISDNAGGIAEMAGMSHRIRERTDALDAAGNTTAAIGKGFAIGSAALVSLALFGAFVSRAEITTVDVLTPKVFIGLIVGAMLPYWFSAMTMKSVGKAALKMVEEVRRQFNEIPGLMEGTAKPDYATCVKISTDASIKEMIPPGALVMLTPLIVGILFGVETLSGVLAGSLVSGVQIAISASNTGGAWDNAKKYIEAGVSDHAKSLGPKGSDAHKAAVIGDTVGDPLKDTSGPSLNILIKLMAVESLVFAPFFATHGGLLFKIFE

SEQ ID NO: 6722 - protein, 767 aa, Sequoia sempervirens
MGEALLSSMLTEILIPVAAVIGIVYALIQWFVVSKVKVVPGYANGSNNGANSKNGFTEYLIEEEEGGNDHSVVTKCADIQNAISEGATSFLFTEYQYMGVFMICFAVIIFLFLGSVEKFSTKDQPCTYNKELMCKPALANAVFSTVSFLLGSLTSVLSGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGTSHDFTAMCFPLLISSMGIIVCLITTSFATDISEIKAVKEIEPALKKQLIISTVLMTIGIAVVSFVALPSSFTIFNFGEQKVVKNWHLFFCVAVGLWAGLVIGFVTEYYTSNAYSPVQDVADSCRTGAATNVIFGLALGYKSVIIPIFAIAISIFVSFSLAAMYGIAVAALGMLSTIATGLAIDAYGPISDNAGGIAEMAGMSHRIRERTDALDAAGNTTAAIGKGFAIGSAALVSLALFGAFVSRAAIPTVDVLTPKVFIGLIVGAMLPYWFSAMTMKSVGSAALKMVEEVRRQFNTIPGLMEGTAKPDYATCVKISTDASLKEMIPPGCLVMLTPLIVGTLFGVETLSGVLAGALVSGVQVAISASNTGGAWDNAKKYIEAGASEHARTLGPKGSDPHKAAVIGDTIGDPLKDTSGPSLNILIKLMAVESLVFAPFFATHGGLLFKL

SEQ ID NO: 6723 - protein, 764 aa, Taraxacum officinale
MGTPTILSDLGTEIIIPICAVVGIIFSLFQWYLVSKVKLSLEKPAADGKNGFTEALIEEEEGINDHTVVQKCAEIQTAISEGATSFLYTEYQYVGIFMVIFAVLIFVFLGSVEGFSTSSQVCTYDTTKMCKPALATAGFSAVAFVLGAVTSVISGFLGMKIATYANARTTLEARKGVGKAFIVAFRSGAVMGFLLAANGLLVLYITINLFKIYYGDDWEGLFESITGYGLGGSSMALFGRVAGGIYTKAADVGADLVGKVERNIPEDDPRNPAVIADNVGDNVGDIAGMGSDLFGSYAESSCAALVVASISSFGINHEFTAMMYPLIVSSIGILVCLITTLFATDFFEVKTVKQIEPALKNQLIISTVLMTIGVALVSWIALPSSFTIFNFGAQKVVKNWQLFLCVCVGLWAGLIIGFVTEYYTSNAYSPVQDVADSCRTGAATNVIFGLALGYKSVIIPIFAIAVSIFVSFTFAAMYGVAVAALGMLSTIATGLAIDAYGPISDNAGGIAEMAGMSHRIRERTDALDAAGNTTAAIGKGFAIGSAALVSLALFGAFVSRAEITTVDVLTPKVFIGLLVGAMLPYWFSAMTMKSVGKAALKMVEEVRRQFNEIPGLMEGTAKPDYATCVKISTDASIKEMIPPGALVMLTPLIVGILFGVETLSGVLAGSLVSGVQIAISASNTGGAWDNAKKYIEAGVSDHAKSLGPKGSDAHKAAVIGDTVGDPLKDTSGPSLNILIKLMAAESLVFAPFFAAHGGVLFKFF

SEQ ID NO: 6724 - protein, 765 aa, Arnica chamissonis
MAPAVLSSFATEIIIPVCSVIGIIFSLLQWFLVSRVKVTPDRNGPPSSNNKNGYDDYLIEEEEGVNDHNVVIKCAEIQNAISEGSTSFLFTMYQYVGIFMVVFAILIFLFLGSVEGFSTKSKKCTYDVTMMCKPALATAAFSTIAFLLGAITSIISGFLGMKIATYANARTTLEARKGVGKAFVTAFRSGAVMGFLLAANGLLVLYITINVFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIEHDFTAMCYPLLVSSVGILVCLITTLFATDFFEIKVVDEIQSALKKQLIISTVLMTVGIAIVSFIGLPTSFTIYNFGVQKVVYNWQLFLCVCVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAGIQTVDVLTPKVFIGLIVGAMLPYWFSAMTMKSVGSAALKMVEEVRRQFNTIPGLMEGLAKPDYTTCVKISTDASLKEMIPPGALVMLTPLIVGTFFGVETLSGVLAGALVSGVQVAISASNTGGAWDNAKKYIEAGASEHARSLGPKGSDPHKAAVIGDTIGDPLKDTSGPSLNILIKLMAVESLVFAPFFAAHGGLLFKL

SEQ ID NO: 6725 - protein, 696 aa, Theobroma cacao
VLKCAEIQNAISEGATSFLFTEYQYVGIFMVAFAILIFLFLGSVEGFSTKSQPCMYDQSKMCKPALATAAFSTISFLLGAVTSVVSGFLGMKIATYANARTTLEARKGVGKAFITAFRSGAVMGFLLAANGLLVLYIAINLFKLYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGINHELTPMLYPLIISSVGILVCLITTLFATDFFEIKAVKEIEPSLKRQLIISTVLMTVGIGIVSWIALPSSFTIFNFGDQKAVKNWQLFLCVSVGLWAGLIIGFVTEYYTSNAYSPVQDVADSCRTGAATNVIFGLALGYKSCIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGSAKPDYATCVKISTDASIKEMIPPGALVMLTPLLVGIFFGVETLSGVLAGSLVSGVQIAISASNTGGAWDNAKKYIEAGASEHARSLGPKGSDPHKAAVIGDTIGDPLKDTSGPSLNILIKLMAVESLVFAPFFATHGGLLFKIF

SEQ ID NO: 6726 - protein, 765 aa, Pseudotsuga menziesii
MGGALLSETLTEVLIPVAAVVGIVFALIQWFLVSRVKVAPDHSHTPSNNNKNGFSEYLIEEEEGINDHNVVNKCAEIQNAISEGANSFLFTEYQYMGVFMVCFAILIFLFLGSVEKFSTKSQPCTYNKEVMCKPALANAIFSTISFLLGSLTSCFSGYLGMKIATYANARTTLEARKGVGKAFITAFRSGAVMGFLLAANGLLVLYVTINLFKLYYGNDWEGLFEAITGYGLGGSSMALFGRVGGGIYTKAADVGADLVGKVERNIPEDDPRNPAVIADNVGDNVGDIAGMGSDLFGSYAEASCAALVVASISSFGNTHDFTAMCYPLLISSMGIIACLITTLFATDIFEIKAVKEIEPALKKQLIISTVLMTIGIAVVSLVALPSSFTIFNFGAQKVVKNWELFFCVAIGLWAGLVIGFVTEYYTSNAYSPVQDVADSCRTGAATNVIFGLALGYKSVIIPIFAIAVGIFVSFSLAAMYGIAVAALGMLSTIATGLAIDAYGPISDNAGGIAEMAGMSHRIRERTDALDAAGNTTAAIGKGFAIGSAALVSLALFGAFVSRAAIQTVDVLTPKVFIGLIVGAMLPYWFSAMTMKSVGSAALKMVEEVRRQFNTIPGLMEGHAKPDYATCVKISTDASLREMIPPGCLVMLTPLIVGTLFGVETLSGVLAGALVSGVQVAISASNTGGAWDNAKKYIEAGASEHARSLGPKGSDPHKAAVIGDTIGDPLKDTSGPSLNILIKLMAVESLVFAPFFATHGGLLFKL

SEQ ID NO: 6727 - protein, 765 aa, Silene vulgaris
MIPDLATQIIIPTCAVVGIIFSLFQWFIVAKVKVTPEKQHINNGGSSKNGFHDRLIDEEEEGVDGDEAVLKCAEIQNAISEGATSFLFTEYQYVGVFMVAFAALIFLFLGSVEGFSTETRRCTYNPFKTCKPALATAVFSTVAFMLGAITSVISGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEYTAMCYPLLISSVGIIVCLITTLFATDFFEIKAVKEIEPALKMQLIISTALMTVGVAVISWIALPSSFTIFNFGTQKVVQNWQLFLCVCVGLWAGLIIGFVTEYYTSNAYSPVQDVADSCRTGAATNVIFGLALGYKSVIIPIFAIAVSIFISFSFAAMYGVAVAALGMLSTIATGLAIDAYGPISDNAGGIAEMAGMSHKIRERTDALDAAGNTTAAIGKGFAIGSAALVSLALFGAFVSRASIATVDVLTPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGSLVSGVQVAISASNTGGAWDNAKKYIEAGVSEHAKSLGPKGSEPHKAAVIGDTIGDPLKDTSGPSLNILIKLMAVESLVFAPFFATHGGLLFKIFS

SEQ ID NO: 6728 - protein, 763 aa, Sorghum bicolor
MAILSPLATEVFIPVAAVIGIVFAVVQWVLVSRVKLSPTAAAASGGGKNGYGDYLIEEEEGLNDHNVVVKCAEIQNAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEVKAVKEIEPALKKQLIISTALMTVGIAVISWLALPAKFTIYNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVTVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGILFKYL

SEQ ID NO: 6729 - protein, 771 aa, Brassica napus
MVALAFLPELWTEILIPVCAVVGIVFSLFQWFIVSRVRVSADQGASSSSGGANNGKNGYGDYLIEEEEGVNDQSVVAKCAEIQTAISEGATSFLFTEYRYVGVFMVIFAAIIFVFLGSVEGFSTENKPCTYDDTKTCKPALATAAFSTIAFILGAVTSVLSGFLGMKIATYANARTTLEARKGVGKAFIVAFRSGAVMGFLLAASGLLVLYITINVFKIYYGEDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKAVKEIEPALKNQLIISTVIMTVGIAIVSYVGLPSSFTIFNFGAQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMVGMSHRIRERTDALDAAGNTTAAIGKGFAIGSAALVSLALFGAFVSRAGVHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYL

SEQ ID NO: 6730 - protein, 767 aa, Sciadopitys verticillata
MGEAMLSEMLTQIVIPVAAVVGIVFALIQWLLVSKVKMVAGHANGSSNNSSSKNGPSEYLIEEEEGINDQSVVAKCAEIQNAISEGANSFLFTEYQYTGIFMVCFAVIIFLFLGSVEKFSTKSQPCNYNPELMCKPALANAVFSTVSFVLGSLTSVLSGYLGMTIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGTSHDFTAMCYPLLISSMGIIVCLITTLFATDIFEIKVVKEIEPALKKQLIISTVLMTIGIAVVSWVALPSSFTIFNFGAQKVVKNWELFFCVAVGLWAGLVIGFVTEYYTSNAYSPVQDVADSCRTGAATNVIFGLALGYKSVIIPIFAIAIGIFVSFSLAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGHAKPDYATCVKISTDASLKEMIPPGCLVMLTPLIVGTLFGVETLAGILAGALVSGVQVAISASNTGGAWDNAKKYIEAGASEHARSLGPKGSDCHKAAVIGDTIGDPLKDTSGPSLNILIKLMAVESLVFAPFFAAHGGLLFKI

SEQ ID NO: 6731 - protein, 763 aa, Sorghum bicolor
MAILSPLATKVFIPVAAVIGIVFAVVQWVLVSRVKLSPTAAAASGGGKNGYGDYLIEEEEGLNDHNVVVKCAEIQNAISEGATSFLFTEYQYVGIFMSIFAVVIFLFLGSVEGFSTKSQPCTYNKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEVKAVKEIEPALKKQLIISTALMTVGIAVISWLALPAKFTIYNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVTVVDVLSPKVFIGLIVGAMLPYWFSAMTMKSVGSAALKMVEEVRRQVNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGILFKYL

SEQ ID NO: 6732 - protein, 764 aa, Cedrus atlantica
MGAALLSETLTEVLIPVAAVVGIGFALIQWFLVSRVKVAPGHLHAPSNNKNGYTDYLIEEEEGINDQNVVIKCAEIQNAISEGANSFLFTEYQYMGVFMVCFAVLIFLFLGSVEKFSTKNQPCTYNKEVMCKPALANAIFSTIAFLLGSLTSIFSGYLGMKIATYANARTTLEARKGVGKAFITAFRSGAVMGFLLAANGLLVLYAAINLFRLYYGNDWEGLFEAITGYGLGGSSMALFGRVGGGIYTKAADVGADLVGKVERNIPEDDPRNPAVIADNVGDNVGDIAGMGSDLFGSYAESSCAALVVASISSFGNSHDFTAMCYPLLISSMGIVVCLITTLFATDIFEIKGVKQIEPALKKQLVISTVLMTIGIAVVSLVALPSSFTIFNFGAQKVVKNWELFFCVAIGLWAGLVIGFVTEYYTSNAYSPVQDVADSCRTGAATNVIFGLALGYKSVIIPIFAIAVSIFVSFSLAAMYGIAVAALGMLSTIATGLAIDAYGPISDNAGGIAEMAGMSHRIRERTDALDAAGNTTAAIGKGFAIGSAALVSLALFGAFVSRAAIQTVDVLTPKVFIGLIVGAMLPYWFSAMTMKSVGSAALKMVEEVRRQFNTIPGLMEGHAKPDYGTCVKISTDASLREMIPPGCLVMLTPLIVGTLFGVETLSGVLAGALISGVQVAISASNTGGAWDNAKKYIEAGASEHARTLGPKGSDPHKAAVIGDTIGDPLKDTSGPSLNILIKLMAVESLVFAPFFATHGGLLFKI

SEQ ID NO: 6733 - protein, 767 aa, Oryza sativa
MAILSALGTEVFIPVAAAVGVAFAVAQWLLVARVKVNPAHAAAAAASGGSKNGGYGDYLIEEEEGLNDHNVVVKCHEIQTAISEGATSFLFTEYQYVGIFMSIFAVVIFLFLGSVEGFSTKSQPCTYSKDKYCKPALFNALFSTASFLLGAITSLVSGYLGMKIATFANARTTLEARKGVGKAFIIAFRSGAVMGFLLASSGLVVLYIAINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEIKAVKEIEPALKKQLIISTALMTVGIAIISWLALPAKFTIFNFGAQKEVTNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNSIPGLMEGTGKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKWF

SEQ ID NO: 6734 - protein, 762 aa, Hordeum vulgare
MAILGELGTEILIPVCGVIGIVFAVAQWFIVSKVKVTPGAASAAAGAKNGYGDYLIEEEEGLNDHNVVVKCAEIQTAISEGATSFLFTMYQYVGMFMVVFAAIIFLFLGSIEGFSTKGQPCTYSKGTCKPALYTALFSTASFLLGAITSLVSGFLGMKIATYANARTTLEARKGVGKAFITAFRSGAVMGFLLSSSGLVVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAANEIEPALKKQLIISTALMTVGVAVISWLALPAKFTIFNFGAQKEVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGLLFKYI

SEQ ID NO: 6735 - protein, 765 aa, Abies balsamea
MGATMLSETLTEVLIPVAAVVGIVFALVQWYLVSRVKVVPDQSHASNDNNKNGYSEYLIEEEEGINDQNVVTKCAEIQNAISEGANSFLFTEYQYMGVFMVCFALLIFLFLGSVEKFSTSSQPCMYNKEVMCKPALANAIFSTISFLLGSLTSIFSGYLGMKIATYANARTTLEARKGVGKAFITAFRSGAVMGFLLAANGLLVLYATINLFRLYYGNDWEGLFEAITGYGLGGSSMALFGRVGGGIYTKAADVGADLVGKVERNIPEDDPRNPAVIADNVGDNVGDIAGMGSDLFGSYAESSCAALVVASISSFGNTHDFTAMCYPLLISSMGIIACLLTTLFATDIFEIKAVKEIEPALKKQLIISTVFMTVGIAVVSFVALPSSFTIFNFGAQKVVKNWELFFCVAIGLWAGLVIGFVTEYYTSNAYSPVQDVADSCRTGAATNVIFGLALGYKSVIIPIFAIAVSIFVSFSLAAMYGIAVAALGMLSTIATGLAIDAYGPISDNAGGIAEMAGMSHRIRERTDALDAAGNTTAAIGKGFAIGSAALVSLALFGAFVSRAAIQTVDVLTPKVFIGLIVGAMLPYWFSAMTMKSVGSAALKMVEEVRRQFNTIPGLIEGHAKPDYGTCVKISTDASLREMIPPGCLVMLTPLIVGTLFGVETLSGVLAGALVSGVQVAISASNTGGAWDNAKKYIEAGASDHARSLGPKGSDPHKAAVIGDTIGDPLKDTSGPSLNILIKLMAVESLVFAPFFATHGGLLFKL

SEQ ID NO: 6736 - protein, 513 aa, Triticum aestivum
MAILGELGTEILIPVCGVVGIVFAVAQWFIVSKVKVTPGAASAAAGSKNGYGDYLIEEEEGLNDHNVVVKCAEIQTAISEGATSFLFTMYQYVGMFMVVFAAIIFLFLGSIEGFSTKGQPCTYSTGTCKPALYTALFSTASFLLGAITSLVSGFLGMKIATYANARTTLEARKGVGKAFITAFRSGAVMGFLLSSSGLVVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAASEIEPALKKQLIISTALMTIGVAVISWLALPAKFTIFNFGAQKDVSNWGLFFCVAVGLWAGLIIGFVTESTLAMPTALCKMLPIPAELVLPPTSSSVLPWVTSQSSSQFSLLLSASTSASLLLQCTALQWLLLACLAQWQLVLLSMLMVPLVTMLVELLRWLA

SEQ ID NO: 6737 - protein, 762 aa, Triticum aestivum
MAILGELGTEILIPVCGVVGIVFAVAQWFIVSKVKVTPGAASAAGGGKNGYGDYLIEEEEGLNDHNVVVKCAEIQTAISEGATSFLFTMYQYVGMFMVVFAAVIFVFLGSIEGFSTKGQPCTYSTGTCKPALYTALFSTASFLLGAITSLVSGFLGMKIATYANARTTLEARKGVGKAFITAFRSGAVMGFLLSSSGLGVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAASEIEPALKKQLIISTALMTIGVAVISWLALPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIREMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFKYI

SEQ ID NO: 6738 - protein, 762 aa, Triticum aestivum
MAILGELGTEILIPVCGVVGIVFAVAQWFIVSKVKVTPGAASAAGGGKNGYGDYLIEEEEGLNDHNVVVKCAEIQTAISEGATSFLFTMYQYVGMFMVVFAAVIFVFLGSIEGFSTKGQPCTYSTGTCKPALYTALFSTASFLLGAITSLVSGFLGMKIATYANARTTLEARKGVGKAFITAFRSGAVMGFLLSSSGLVVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAASEIEPALKKQLIISTALMTIGVAVISWLALPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIREMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFKYI

SEQ ID NO: 6739 - protein, 795 aa, Fragaria vesca
LSLRYFTLSSLLLVFSIFEFSGVRIPARMAVLLSYLATEIVIPVCAVVGILFSLLQWYLVSRVRVTPDRNAPAPGTNAKKNGFNDYLIEEEEGVTDQNVVAKCAEIQNAISEGATSFLFTEYQYVGVFMVVFAVLIFLFLGSVKGFSTESQPCTYDVTSTCKPALATALFSTVAFLLGGITSLLSGFLGMKIATYANARTTLEARKGVGKAFIVAFRSGAVMGFLLAANGLLVLYITINLFQLYYGDDWEGLFEAITGYGLGGSAMALFGRVGGGIYTKAADVGADLVGKIERNIPEDDPRNPAVIADNVGDNVGDIAGMGSDLFGSYAESSCAALVVASISSFGINHEFTAMLYPLLVSSMGILICLITTLFATDFFEIKAVKDIEPALKNQLIISTVLMTIGIAIVSWVALPSSFTIYNFGVQKVVKNWQLFLCVSVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGLAKPDYATCVKISTDASIKEMIPPGALVILTPLIVGTLFGVETLSGVLAGSLVSGVQVAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 6740 - protein, 761 aa, Triticum aestivum
MAILGELGTEILIPVCGVVGIVFAIAQWFIVSKVKVTPGAAAAGGSKNGYGDYLIEEEEGLNDHNVVVKCAEIQTAISEGATSFLFTMYQYVGMFMVVFAAVIFVFLGSIEGFSTKGQPCTYSTGTCKPALYTALFSTASFLLGAITSLVSGFLGMKIATYANARTTLEARKGVGKAFITAFRSGAVMGFLLSSSGLVVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAASEIEPALKKQLIISTALMTIGVAVISWLALPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFRYI

SEQ ID NO: 6741 - protein, 762 aa, Oryza sativa
MAILSDVATEVLIPIAAIIGIGFSIAQWVLVARVKLAPSQPGASRSKDGYGDSLIEEEEGLNDHNVVAKCAEIQNAIAEGATSFLFTEYQYVGVFMSIFAVVIFLFLGSVEGFSTKTHPCTYSKDKECKPALFNALFSTVSFLLGAITSVVSGFLGMKIATYANARTTLEARKGVGKAFITAFRSGAVMGFLLASNGLLVLYIAINLFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSMGIIVCLITTLFATDFFEIKAVKEIEPSLKKQLIISTALMTVGIALVSWLALPYKFTIFNFGEQKEVTNWGLFLCVSIGLWAGLIIGYVTEYYTSNAYSPVQDVADACRTGAATNVIFGLALGYKSVIIPIFAIALGIYVSFTIAAMYGIAVAALGMLSTIATGLSIDAYGPISDNAGGIAEMAGMSHRIRERTDALDAAGNTTAAIGKGFAIGSAALVSLALFGAFVSRAGVKVVDVLSPKVIIGLIVGAMLPYWFSAMTMKSVGSAALKMVEEVRRQFNTIPGLMEGTGKPDYANCVKISTDASIKQMIPPGALVMLTPLIVGTLFGVQTLSGVLAGALVSGVQVAISASNTGGAWDNAKKYIEAGASEHARSLGPKGSDCHKAAVIGDTIGDPLKDTSGPSLNILIKLMAVESLVFAPFFATHGGILFKLF

SEQ ID NO: 6742 - protein, 761 aa, Triticum aestivum
MAILGELGTEILIPVCGVVGIVFAIAQWFIVSKVKVTPGAAAAGGSKNGYGDYLIEEEEGLNDHNVVVKCAEIQTAISEGATSFLFTMYQYVGMFMVVFAAVIFVFLGSIEGFSTKGQPCTYSTGTCKPALYTALFSTASFLLGAITSLVSGFLGMKIATYANARTTLEARKGVGKAFITAFRSGAVMGFLLSSSGLVVLYITINGFKKYYGDDWEGLFESITGYGLGGSSMALFGRVGGGIYTKAADVGADLVGKVERNIPEDDPRNPAVIADNVGDNVGDIAGMGSDLFGSYAESSCAALIVASISSFGINHDFTAMCYPLLVSSVGIIVCLLTTLFATDFFEIKAASEIEPALKKQLIISTALMTIGVAVISWLALPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFRYI

SEQ ID NO: 6743 - protein, 417 aa, Avena sativa
MAILGELGTQVLIPVAGVIGIVFAVAQWVIVSKVKVTPGAANASGAGKNGYGDYLIEEEEGLNDHNVVVKCAEIQTAISEGATSFLFTMYQYVGFFMVIFAGLIFVFLGSIEGFSTKGQPCTYSQGKTCKPALYTALFSTAAFLLGAITSLVSGFLGMKIATYANARTTLEARKGVGKAFITAFRSGAVMGFLLSSSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAANEIEPALKKQLIISTALMTVGVAIISWLALPASSPSSISVLRRKLPTGACSSVWELDSGLVSLLGL

SEQ ID NO: 6744 - protein, 762 aa, Brachypodium distachyon
MAILSALGTEVFIPVAAVIGIVFAVVQWVLVARVKVTPGAAGATGAKNGYGDYLIEEEEGLNDHNVVVKCAEIQTAISEGATSFLFTMYQYVGIFMIIFAVLIFLFLGSIEGFSTKGKPCTYSKDKICKPALYTALFSTASFLLGAITSLVSGFLGMKIATYANARTTLEARKGVGKAFITAFRSGAVMGFLLSSSGLVVLYITINVFKVYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLLTTFFATDFFEIKAANEIEPALKKQLIISTALMTVGVAIISWLALPAKFTIFNFGTQKEVANWGLFFCVSIGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLVVGTFFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFNYL

SEQ ID NO: 6745 - protein, 574 aa, Triticum aestivum
MAILGELGTEILIPVCGVVGIVFAVAQWFIVSKVKVTPGAASAAAGSKNGYGDYLIEEEEGLNDHNVVVKCAEIQTAISEGATSFLFTMYQYVGMFMVVFAAIIFLFLGSIEGFSTKGQPCTYSTGTCKPALYTALFSTASFLLGAITSLVSGFLGMKIATYANARTTLEARKGVGKAFITAFRSGAVMGFLLSSSGLVVLYITINVFKMYYGDDWEGLFESITGYGPGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAASEIEPALKKQLIISTALMTIGVAVISWLALPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVNKAGVKVVMSYLPRGSLV

SEQ ID NO: 6746 - protein, 720 aa, Panicum virgatum
AGGSKNGYGDYLIEEEEGLNDHNVVVKCAEIQNAISEGATSFLFTEYQYVGIFMSIFAVVIFLFLGSVEGFSTKSQPCTYSVGKYCKPALFTALFSTASFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEIKAVKEIEPALKKQLIISTALMTVGIAIISWLALPAKFTIFNFGTQKEVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVQVVDVLSPKVFIGLIVGAMLPYWFSAMTMKSVGSAALKMVEEVRRQFNTIPGLMEGTGKPDYATCVKISTDASIKEMIPPGALVMLTPLIVGTFFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKYL

SEQ ID NO: 6747 - protein, 720 aa, Panicum virgatum
AGGSKNGYGDYLIEEEEGLNDHNVVVKCAEIQNAISEGATSFLFTEYQYVGIFMSIFAVVIFLFLGSVEGFSTKSQPCTYSEGKFCKPALFTALFSTASFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEIKAVKEIEPALKKQLIISTALMTVGIAIISWLALPAKFTIFNFGTQKEVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTGKPDYATCVKISTDASIKEMIPPGALVMLTPLIVGTFFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKYL

SEQ ID NO: 6748 - protein, 720 aa, Saccharum officinarum
SGGGKNGYGDYLIEEEEGLNDHNVVVKCAEIQNAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEVKAVKEIEPALKKQLIISTVLMTVGIAVISWLALPAKFTIYNFGIQKAVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVTVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGILFKYL

SEQ ID NO: 6749 - protein, 635 aa, Sequoia sempervirens
MCKPALANAIFSAIAFLLGALTSVLSGFLGMKIATYANARTTLEARKGVGKAFITAFRSGAVMGFLLAANGLLVLYITINVFKIYYGDDWEGLFEAITGYGLGGSAMALFGRVGGGIYTKAADVGADLVGKVEQNIPEDDPRNPAVIADNVGDNVGDIAGMGSDLFGSYAESSCAALVVASISSFGNNHDFTSMCYPLLISSMGIVICLITTLFATDFFEIKAVKEIEPSLKRQLIISTVLMTIGIAIVSFVALPSTFTIFNFGAAKTVKNWHLFFCVSIGLWAGLVIGYVTEYYTSNAYSPVQEVAESCKTGAATNVIFGLALGYKSVIIPIFAIAVAIFVSFSLAAMYGIAVAALGMLSTIATGLAIDAYGPISDNAGGIAEMAGMNHKIRERTDALDAAGNTTAAIGKGFAIGSAALVSLALFGAFVSRAAITSVDVLTPKVFIGLIVGAMLPYWFSAMTMKSVGSAALKMVEEVRRQFKNIPGLMEGTAKPDYATCVKISTDASLKEMIPPGALVMLTPLIVGILFGVETLSGVLAGALVSGVQVAISASNTGGAWDNAKKYIEAGASAAARELGPKGSDAHKAAVIGDTIGDPLKDTSGPSLNILIKLMAVESLVFAPFFAAHGGILFKI

SEQ ID NO: 6750 - protein, 765 aa, Sciadopitys verticillata
MGLPMLSEMLTEILIPLAAVIGILFALLQWLLVSRVKVTPGVRASGTSNNGYNDNLLDEDDEEGVDGRLVVTKCAEIQNAISEGATSFLFTEYKYLGIFMVCFGAIIFLFLGSVESFSTKSQPCTYQTEKMCKPALANAIFSTIAFLLGALTSVLSGFLGMKIATYANARTTLEARKGVGKAFITAFRSGAVMGFLLAANGLLVLYISINVFKIYYGEDWEGLFEAITGYGLGGSAMALFGRVGGGIYTKAADVGADLVGKIEQNIPEDDPRNPAVIADNVGDNVGDIAGMGSDLFGSYAEASCAALVVASISSFGNTHDFTSMCYPLLISSMGILICLITTLFATDFFEIKVVKEIEPSLKRQLIISTVLMTIGIAIVSFVGLPSTFTIYNFGSVKVVKNWHLFFCVAIGLWAGLVIGYTTEYYTSNAYSPVQEVAQSCRTGAATNVIFGLALGYKSVIIPIFAIAVAIFVSFSLAAMYGIAVAALGMLSTIATGLAIDAYGPISDNAGGIAEMAGMNHKIRERTDALDAAGNTTAAIGKGFAIGSAALVSLALFGAFVSRAAITKVDVLTPKVFIGLIVGAMLPYWFSAMTMKSVGSAALKMVEEVRRQFRTIPGLMEGTTKPDYATCVKISTDASLKEMIPPGALVMLTPLIVGTLFGVETLSGVLAGALVSGVQVAISASNTGGAWDNAKKYIEAGASAAAKELGPKGSDAHKAAVIGDTIGDPLKDTSGPSLNILIKLMAVESLVFAPFFAKHGGILFKL

SEQ ID NO: 6751 - protein, 786 aa, Pinus taeda
MGGALLSETLTEILIPVAAVIGIGFALIQWVLVSRVKVSPDHSHTPSNNNKNGYSEYLIEEEEGLNDHNVVNKCAEIQNAISEGANSFLFTEYQYMGIFMVCFAALIFLFLGSVEKFSTKSQPCTYNKEVMCKPALANAIFSTIAFLLGSLTSILSGYLGMKIATYANARTTLEARKGVGKAFITAFRSGAVMGFLLAANGLLVLFIAIILFKLYYGNDWEGLFEAITGYGLGGSSMALFGRVGGGIYTKAADVGADLVGKVERNIPEDDPRNPAVIADNVGDNVGDIAGMGSDLFGSYAESSCAALVVASISSFGNSHDLTAMCYPLLISSMGIIACLITTLFATDIFEIKAVKEIEPALKKQLIISTVVMTIGIAAVSLVALPSSFTIFNFGAQKVVKNWELFFCVAIGLWSGLVIGFVTEYYTSNAYSPVQDVADSCRTGAATNVIFGLALGYKSVIIPIFAIAVSIFVSFSLAAMYGIAVAALGMLSTIATGLAIDAYGPISDNAGGIAEMAGMSHRIRERTDALDAAGNTTAAIGKGFAIGSAALVSLALFGAFVSRAAIQTVDVLTPKVFIGLIVGAMLPYWFSAMTMKSVGSAALKMVEEVRRQFNTIPGLMEGHGKPDYGTCVKISTDASLKEMIPPGCLVMLTPLIVGTLFGVETLSGVLAGALVSGVQVAISASNTGGAWDNAKKYIEAGASRTLGPKGSDPHKAAVTIGDPLKDTSGPSLNILIKLMAVESLVFAPFFATHGCLNFSSCRNPFQAVLVGIIFLFEYDEQSLSETL

SEQ ID NO: 6752 - protein, 764 aa, Picea glauca
MGGALLSETLSEILIPVAAVIGIGFSLLQWLLVSRVKVGPEKASSRNNGVYNEFLLDEADEEGTDVRNAVPKCAEIQNAISLGATSFLFTQYKYLGIFTVCFGLLIFLFLGSVEGFSTNQQPCNYDTAKMCKPALANALFSTIAFVLGAFTSVLSGYLGMKIATYANARTTLEARKSVGKAFITAFRSGAVMGFLLAANGLLVLYITINIFKLYYGDDWEGLFEAITGYGLGGSSMALFGRVGGGIYTKAADVGADLVGKIEQNIPEDDPRNPAVIADNVGDNVGDIAGMGSDLFGSYAEASCAALVVASISSFGNNHDFTAMCYPLLISSMGIVICLITTLFATDLFEIKAVKDIEPTLKRQLIISTVLMTVGIAIVSSVGLPSTFTIYNFGAEKVVKSWHLFFCVAVGLWAGLVIGYTTEYYTSNAYSPVQEVAQSCKTGAATNVIFGLALGYKSVIIPIFAIAAAIFVSFSLAAMYGIAVAALGMLSTIATGLAIDAYGPISDNAGGIAEMAGFSHKIRERTDALDAAGNTTAAIGKGFAIGSAALVSLALFGAFVSRAAISKVDVLTPKVFIGLLVGAMLPYWFSAMTMKSVGSAALKMVEEVRRQFRDIPGLMEGTAKPDYATCVKISTDASLREMIPPGALVMLTPLIVGTLFGVETLSGVLAGALVSGVQVAISASNTGGAWDNAKKYIEAGASKAARELGPKGSDAHKAAVIGDTIGDPLKDTSGPSLNILIKLMAVESLVFAPFFATHGGLLFKI

SEQ ID NO: 6753 - protein, 708 aa, Setaria italica
YLIEEEEGLNEHNVVVKCAEIQNAISEGATSFLFTEYKYVGLFMGIFAVLIFLFLGSVEGFSTKSQPCHYSKGKMCKPALANALFSTIAFVLGAVTSLVSGFLGMKIATYANARTTLEARKGVGKAFITAFRSGAVMGFLLAASGLFVLYIAINLFGIYYGDDWEGLYEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLVSSVGIIACLITTLFATDFFEIKAVDEIEPALKKQLIISTAVMTVGIALVSWLGLPYTFTIFNFGVQKTVYNWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGNAIGSAALVSLALFGAFVSRAEISTVDVLSPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKWL

SEQ ID NO: 6754 - protein, 1051 aa, Ricinus communis
WFMALIGATSFLFTEYQYVGIFMVAFAILIFLFLGSVEGFSTKSRPCTFDSQKTCKPALATAIFSTVSFLLGAVTSVLSGFLGMKIATYANARTTLEARKGVGKAFITAFRSGAVMGFLLAANGLLFLYIAINLFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLISSVGILVCLITTLFATDFFEIKAVKEIEPALKKQLVISTILMTVGIAIVTWIGLPSSFTIFNFGTQKVVKNWQLFLCVAVGLWAGLIIGFVTEYYTSNAYSPVQDVADSCRTGAATNVIFGLALGYKSVIIPIFAIAASIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGHAKPDYATCVKISTDASIKEMIPPGALVMLTPLIVGTFFGVETLSGVLAGSLVSGVQIAISASNTGGAWDNAKKYIEAGASEHARSLGPKGSEPHKAAVIGDTIGDPLKDTSGPSLNILIKLMAVESLVFAPFFATHAFADKKEIEDSNKSILESNSKSSSSLSPSLSTATATATAASLSTAAAIMLQFTSTKPPNSLFHSLNSPQFLPNSLCSISLPLHLPLFYTNSSHHPHPLSLRIRAIDAAQPYDYEAQLKSQHLKSQSLKIAFIGFGNFGQFLAKTLSRQGHTLLAYSRTNYTDIAKQLNTRFYNNPHDLCENHPDVLILCTSILSTEKVLKSFPFQRLKRNTLFVDVLSVKEFAKNVLLKYLPIEFDILCTHPMFGPESGKLSWAGLPFVFDKVRIGNNDDRISRCDKFLDIFAREGCRMVEMSCVEHDKYAAGSQFVTHTMGRVLEKFGLESSPINTKGYETLLDLETVVWHLRGIADRPKIQKLLRNGAPSVEPPADVL

SEQ ID NO: 6755 - protein, 764 aa, Abies balsamea
MGNARLSEGITQILIPVAAVIGIGFALLQWVLVSRVKVGPEKASSHNNGSYNEFLLDEADEDGADDRNAVPKCAEIQNAIALGATSFLFTEYKYLGIFTVCFGLIIFLFLGSVEGFSTKHQPCNYDKAKLCKPALANALFSTIAFVLGASTSALSGYLGMKIATYANARTTLEARKGVGKAFITAFRSGAVMGFLLAANGLLVLHISINIFKLYYGDDWEGLFEAITGYGLGGSSMALFGRVGGGIYTKAADVGADLVGKIEQNIPEDDPRNPAVIADNVGDNVGDIAGMGSDLFGSYAEASCAALVVASISSFGSNHDFTAMCYPLLISSMGIVICLITTLFATDFFEIKAVKDIEPSLKRQLIISTVLMTVGVAIVSFVALPSTFSIYNFGSMKEVKNWHLFFCVAVGLWAGLVIGYTTEYYTSNAYSPVQEVAQSCKTGAATNVIFGLALGYKSVIIPIFSIAAAIFVSFSVAAMYGIAVAALGMLSTIATGLAIDAYGPISDNAGGIAEMAGFSHKIRERTDALDAAGNTTAAIGKGFAIGSAALVSLALFGAFVSRAAISTVDVLTPKVFIGLIVGAMLPYWFSAMTMKSVGSAALKMVEEVRRQFKNIPGLMEGTAKPDYATCVKISTDASLKEMIPPGALVMLTPLIVGTLFGVETLSGVLAGALVSGVQVAISASNTGGAWDNAKKYIEAGASKAARELGPKGSDAHKAAVIGDTIGDPLKDTSGPSLNILIKLMAVESLVFAPFFATHGGLLFKI

SEQ ID NO: 6756 - protein, 760 aa, Cephalotaxus harringtonia
MGVPMLSEMLTEILIPLAAVIGIGFALLQWVLVSRVKVTPSTTSNGYNDHLLDEANEDGIDGRQAVIKCAEIQNAISEGATSFLFTEYKYLGIFTMCFGAIIFLFLGSVENFSTKYQACTYQKEKMCKPALANAIFSAIAFLLGALTSVLSGFLGMKIATYANARTTLEARKGVGKAFITAFRSGAVMGFLLAANGLLVLYITINVFKIYYGDDWEGLFEAITGYGLGGSAMALFGRVGGGIYTKAADVGADLVGKVEQNIPEDDPRNPAVIADNVGDNVGDIAGMGSDLFGSYAESSCAALVVASISSFGNTHDFTSMCYPLLISSMGILICLITTLFATDFFEIKAVKEIEPSLKRQLIISTVLMTIGIAIVSFIALPSTFTIFNFGSAKVVKNWHLFFCVSIGLWAGLVIGYTTEYYTSNAYSPVQEVAQSCKTGAATNVIFGLALGYKSVIIPIFAIAVAIFVSFSLAAMYGIAVAALGMLSTIATGLAIDAYGPISDNAGGIAEMAGMNHKIRERTDALDAAGNTTAAIGKGFAIGSAALVSLALFGAFVSRAAITSVDVLTPKVFIGLIVGAMLPYWFSAMTMKSVGSAALKMVEEVRRQFRDIPGLLEGTTKPDYATCVKISTDASLKEMIPPGALVMLTPLIVGILFGVETLSGVLAGALVSGVQVAISASNTGGAWDNAKKYIEAGASAAARELGPKGSDAHKAAVIGDTIGDPLKDTSGPSLNILIKLMAVESLVFAPFFAAHGGILFKI

SEQ ID NO: 6757 - protein, 682 aa, Malus domestica
GATSFLFTEYRYVGAFMVAFAILIFLFLGSVEGFSTSSRACTYDQTKTCKPALATAIFSTISFLLGAVTSVVSGFLGMKIATYANARTTLEARKGVGKAFITAFRSGAVMGFLLASSGLLVLYIAINVFKLYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGINHELTAMLYPLIVSSIGILVCLLTTLFATDFFEIKAVKEIEPTLKRQLIISTVLMTVGVAIATWISVPSSFTIFNFGTQKVVKNWQLFLCVCVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAGIKTVDVLTPKVIIGLLVGAMLPYWFSAMTMKSVGSAALKMVEEVRRQFNTIPGLMEGTAKPDYATCVKISTDASIKEMIPPGALVMLTPLIVGIFFGVETLAGVLAGSLVSGVQIAISASNTGGAWDNAKKYIEAGASEHARTLGPKGSECHKAAVIGDTIGDPLKDTSGPSLNILIKLMAVESLVFAPFFATHGGLLFKI

SEQ ID NO: 6758 - protein, 766 aa, Pinus pinaster
MGGAGALLSESLSQILIPVAAVIGIGFALLQWLLVSRVKVGSEKASSLNNGVYNEVLLEEPEEDGGDLKNAVPKCAEIQDAISLGATSFLFTEYKYLGIFTGCFGLLMFLFLGSVEGFSTQQQQCSYDKTKMCKPALANALFSTIAFVLGAFTSVLSGYFGMKIATYANARTTLEARKGVGKAFITAFRSGAVMGFLLAANGLLVLYLSINVFKLYYGDDWEGLFEAITGYGLGGSSMALFGRVGGGIYTKAADVGADLVGKIELNIPEDDPRNPAVIADNVGDNVGDIAGMGSDLFGSYAEASCAALVVASISSFGSDHDFTAMCYPLLISSMGIVICLITTLFATDLFEIKAVKDIEPTLKRQLIISTVLMTVGIGIVSAVGLPSTFSIYNFGSVKVVKNWHLFFCVAVGLWAGLVIGYITEYYTSNAYSPVQEVAQSCRTGAATNVIFGLALGYKSVIIPIFAIAAAIFVSFSLAAMYGIAVAALGMLSTIATGLAIDAYGPISDNAGGIAEMAGFSHKIRERTDALDAAGNTTAAIGKGFAIGSAALVSLALFGAFVSRAAISTVDVLTPKVFIGLLIGAMLPYWFSAMTMKSVGKAALKMVEEVRRQFKTIPGLMEGTGKPDYATCVKISTDASLKEMIPPGALVMLTPLIVGILFGVETLSGVLAGALVSGVQVAISASNTGGAWDNAKKYIEAGASKAARDLGPKGSDCHKAAVIGDTIGDPLKDTSGPSLNILIKLMAVESLVFAPFFAAHGGLLFKI

SEQ ID NO: 6759 - protein, 764 aa, Pinus taeda
MGGTLLSESLSQILIPVAAVIGIGFALLQWLLVSRVKVGYEKASSLNNGVYNEVLLDEPDEDGGDLKNAVPKCAEIQEAISLGATSFLFTEYKYLGIFTGCFGLLMFLFLGSVEGFSTQQQQCHYDKTEMCKPALANALFSTIAFVLGAFTSVLSGYFGMKIATYANARTTLEARKGVGKAFITAFRSGAVMGFLLAANGLLVLYLSINVFKLYYGDDWEGLFEAITGYGLGGSSMALFGRVGGGIYTKAADVGADLVGKIELNIPEDDPRNPAVIADNVGDNVGDIAGMGSDLFGSYAEASCAALVVASISSFGSDHDFTAMCYPLLISSMGIVICLITTLFATDLFEIKAVKDIEPTLKRQLIISTVIMTVGIGIVSAVALPSTFSIYNFGSVKVVKNWHLFFCVAVGLWAGLVIGYITEYYTSNAYSPVQEVAQSCRTGAATNVIFGLALGYKSVIIPIFAIAAAIFVSFSLAAMYGIAVAALGMLSTIATGLAIDAYGPISDNAGGIAEMAGFSHKIRERTDALDAAGNTTAAIGKGFAIGSAALVSLALFGAFVSRAAISTVDVLTPKVFIGLIVGAMLPYWFSAMTMKSVGKAALKMVEEVRRQFKTIPGLMEGTAKPDYATCVKISTDASLKEMIPPGALVMLTPLIVGTLFGVETLSGVLAGALVSGVQVAISASNTGGAWDNAKKYIEAGASKAARDLGPKGSDCHKAAVIGDTIGDPLKDTSGPSLNILIKLMAVESLVFAPFFAAHGGLLFKI

SEQ ID NO: 6760 - protein, 764 aa, Pseudotsuga menziesii
MGGALLSETLTGILIPVAAVIGIGFALLQWVLVSRVKVGPDSSSSRSNGSYNELLLDEADEDGGDARNAVPKCAEIQNAISEGATSFLFTEYKYLGVFTACFGVIIFLFLGSVQGFSTKQQPCNYDNAKMCKPALANALFSTLAFVLGAVTSVLSGYFGMKIATYANARTTLEARKGVGKAFITAFRSGAVMGFLLAANGLLVLYLSIHIFKLYYGDDWEGLFEAITGYGLGGSSMALFGRVGGGIYTKAADVGADLVGKIEQNIPEDDPRNPAVIADNVGDNVGDIAGMGSDLFGSYAEASCAALVVASISSFGTDHDLTAMSYPLLISSMGIVICLITTLFATDFFEIKAVKDIEPTLKRQLIISTVLMTAGIAVVSFVGLPSTFTIYNFGTLKEVKNWHLFFCVAVGLWAGLVIGYTTEYYTSNAYSPVQEVAQSCRTGAATNVIFGLALGYKSVIIPIFAIAAAIFVSFSLAAMYGIAVAALGMLSTIATGLAIDAYGPISDNAGGIAEMAGFSHKIRERTDALDAAGNTTAAIGKGFAIGSAALVSLALFGAFVSRAAISSVDVLTPKVFIGLLVGAMLPYWFSAMTMKSVGSAALKMVEEVRRQFKNIPGLMEGTAKPDYATCVKISTDASLREMIPPGALVMLTPLIVGTLFGVETLAGVLAGALVSGVQVAISASNTGGAWDNAKKYIEAGASKAARELGPKGSDCHKAAVIGDTIGDPLKDTSGPSLNILIKLMAVESLVFAPFFATHGGVLFKF

SEQ ID NO: 6761 - protein, 759 aa, Malus domestica
MGLLSEGLTQVVIPLAAVVGLGFALLQWFLVSKVKVSGGHGERNGFKDKLIGDEEEGVSSVEVTIKCAEIQHAISIGATSFLFTQYRYLSIFVGVFSTIIFLFLGSVKGFSTKSEACTYNTGNMCKPALANAFFSTIAFLLGAFTSVLSGFLGMKIATYANARTTLEARRGVGKAFITAFRSGAVMGFLLAANGLLVLYITINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGIGHDYTAMSYPLIISSMGIVVCLVTTLFATDLFEIKKVSEIEPALKRQLVISTVLMTVGIAVVTFVALPSEFTLFSFGTNKAVKNWYLFFCVAIGLWAGLVIGYTTEYYTSNAYSPVQDVADSCRTGAATNVIFGLALGYKSVIIPVFAIAFAIYVSFSLAAMYGIAVAALGMLSTISTGLAIDAYGPISDNAGGIAEMAGMSHEIRERTDALDAAGNTTAAIGKGFAIGSAALVSLALFGAYVSRAGIETVDVLTPKVFIGLLVGAMLPYWFSAMTMKSVGSAALKMVEEVRRQFNTIPGLMEGTAKPDYATCVKISTDASLKEMIPPGALVMLTPLIAGTFFGVETLAGILAGSLVSGVQIAISASNTGGAWDNAKKYIEAGASEHAKSLGPKGSEPHKAAVIGDTIGDPLKDTSGPSLNILIKLMAVESLVFAPFFAAHGGLLFKWL

SEQ ID NO: 6762 - protein, 764 aa, Cedrus atlantica
MGDALLSENLTQILIPVSAVVGIGFALLQWVLVSRVKVGSEKASSQSNGSYNEFLLDEADEDGADIRNAVPKCAEIQNAISLGATSFLFTEYKYLGIFTGCFGVIIFLFLGSVKGFSTKIQTCNYDTTKMCKPALANALFSTIAFVLGAFTSVLSGYLGMKIATYANARTTLEARKGVGKAFITAFRSGAVMGFLLAANGLLVLYISINIFKLYYGDDWEGLFEAITGYGLGGSSMALFGRVGGGIYTKAADVGADLVGKIEQNIPEDDPRNPAVIADNVGDNVGDIAGMGSDLFGSYAEASCAALVVASISSFGSDHDFTAMCYPLLISSMGIVICLITTLFATDFFEIKAVKDIEPSLKRQLIISTVLMTGGIAIVSFVALPSTFTIYNFGSAKSVKNWHLFFCVAIGLWAGLVIGYITEYYTSNAYSPVQEVAQSCKTGAATNVIFGLALGYKSVIIPIFAIAAAIFVSFSLAAMYGIAVAALGMLSTIATGLAIDAYGPISDNAGGIAEMAGFSHKIRERTDALDAAGNTTAAIGKGFAIGSAALVSLALFGAFVSRAAISTVDVLTPKVFIGLIVGAMLPYWFSAMTMKSVGSAALKMVEEVRRQFKNIPGLMEGTAKPDYATCVKISTDASLKEMIPPGCLVMLTPLIVGTLFGVETLSGVLAGALVSGVQVAISASNTGGAWDNAKKYIEAGASKAARELGPKGSDAHKAAVIGDTVGDPLKDTSGPSLNILIKLMAVESLVFAPFFATHGGILFKI

SEQ ID NO: 6763 - protein, 759 aa, Malus domestica
MGLLSEGLTQIVIPLAAVVGLGFALLQWFLVSRVKVSGGHGERNGYKDKLIGEEEEGVNSLEVTIKCAEIQHAISIGATSFLFTQYKYLSIFVGVFSAIIFLFLGSVKGFSTKSEPCTYNTGNMCKPALANAFFSTVAFLLGAFTSVLSGFLGMKIATYANARTTLEARRGVGKAFITAFRSGAVMGFLLAANGLLVLYASINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGIGHDYTAMSYPLIISSMGIVVCLVTTLFATDLFEIKKVSEIEPALKRQLLISTVFMTAGIAAVTFVSLPSEFTLFSFGTNKAVKNWYLFFCVSIGLWAGLVIGYTTEYYTSNAYSPVQDVADSCRTGAATNVIFGLALGYKSVIIPVFAIAFAIYVSFSLAAMYGIAVAALGMLSTISTGLAIDAYGPISDNAGGIAEMAGMSHKIRERTDALDAAGNTTAAIGKGFAIGSAALVSLALFGAYVSRAGIETVDVLTPKVFIGLIVGAMLPYWFSAMTMKSVGSAALKMVEEVRRQFNTIPGLMEGTAKPDYATCVKISTDASLREMIPPGALVMLTPLVAGTFFGVETLAGILAGSLVSGVQIAISASNTGGAWDNAKKYIEAGGSEHAKSLGPKGSEPHKAAVIGDTIGDPLKDTSGPSLNILIKLMAVESLVFAPFFAAHGGLLFKWL

SEQ ID NO: 6764 - protein, 395 aa, Gossypium hirsutum
MTIGIGIVSWVALPSSFTIFNFGDQKAVKNWQLFLCVAVGLWAGLIIGFVTEYYTSNAYSPVQDVADSCRTGAATNVIFGLALGYKSCIIPIFAIAMSIFVSFSFAAMYGIAVAVLGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 6765 - protein, 761 aa, Solanum phureja
MGLMSEALTQILIPLAAFIGIGFALLQWFLVSKVRVSSGSNLVSEYNDKLIEEDEQEEGIDSDDVVAKCADIQKAISEGATSFLFTEYKYLGIFMVVFGAIIFLFLGSVKSFSTESEPCTFNKEKICKPALANAFFTTIAFFLGGLTSALSGFLGMKIATYANARTTLEARKSIGKAFIIAFRSGAVMGFLLAANGLLVLYISINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGSSHDYSAMSYPLIISSMGIVVCLITTLFATDMFEIKNVTEIEPSLKRQLLISTVLMTVGIAFVSFFALPSEFTIFDFGSEKVVKNWHLFFCVSIGLWAGLVIGYTTEYYTSSAYSPVQEVADSCKTGAATNVIFGLALGYKSVIIPIFAIAASIYVSFSLAAMYGIAVAALGMLSTIATGLAIDAYGPINDNAGGIAEMAGMSHSIRERTDALDAAGNTTAAIGKGFAIGSAALVSLALFGAYVSRAGIKTVDVLSPKVFIGLLVGAMLPYWFSAMTMKSVGSAALKMVEEVRRQFNSIPGLMEGTAKPDYATCVKISTDASLKEMIPPGALVMLTPLIAGTFFGVETLAGVLAGSLVSGVQVAISASNTGGAWDNAKKYIEAGATEHARSLGPKGSDAHKAAVIGDTVGDPLKDTSGPSLNILIKLMAVESLVFAPFFATHGGLLFKLL

SEQ ID NO: 6766 - protein, 759 aa, Malus domestica
MGLLSEGLTQVVIPLAAVVGLGFALLQWFLVSKVKVSGGHGERNGFKDKLIGDEEEGVSSVEVTIKCAEIQHAISIGATSFLFTQYRYLSIFVGVFSTIIFLFLGSVKGFSTKSEACTYNTGNMCKPALANAFFSTIAFLLGAFTSVLSGFLGMKIATYANARTTLEARRGVGKAFITAFRSGAVMGFLLAANGLLVLYITINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGIGHDYTAMSYPLIISSMGIVVCLVTTLFATDLFEIKKVSEIEPALKRQLLISTVFMTAGIAAVTFVSLPSEFTLFSFGTNKAVKNWYLFFCVSIGLWAGLVIGYTTEYYTSNAYSPVQDVADSCRTGAATNVIFGLALGYKSVIIPVFAIAFAIYVSFSLAAMYGIAVAALGMLSTISTGLAIDAYGPISDNAGGIAEMAGMSHKIRERTDALDAAGNTTAAIGKGFAIGSAALVSLALFGAYVSRAGIETVDVLTPKVFIGLIVGAMLPYWFSAMTMKSVGSAALKMVEEVRRQFNTIPGLMEGTAKPDYATCVKISTDASLREMIPPGALVMLTPLVAGTFFGVETLAGILAGSLVSGVQIAISASNTGGAWDNAKKYIEAGGSEHAKSLGPKGSEPHKAAVIGDTIGDPLKDTSGPSLNILIKLMAVESLVFAPFFAAHGGLLFKWL

SEQ ID NO: 6767 - protein, 759 aa, Sorghum bicolor
MAILSEVATEVLIPLAAAVGIAFAVAQWVLVSRVKLAPSSGRDKDVLAESLIEEEEGLNDHNVVVRCAEIQCAIAEGATSFLFTEYRYVGAFMCVFAAVIFVFLGSVDGFSTQSRPCAYSEGKQCKPALFNAVFSTVAFLLGAATSVVSGFLGMKVATYANARTTLEARKGVGRAFVTAFRSGAVMGFLLASSGLLVLYVAINLFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGVSHDFTGMCYPLLVSSVGIVVCLVTTLFATDFFEIKDVKQIEPALKKQLIISTALMTAGIALITWLALPANFTIFNFGEQKEVSNWGLFLCVAIGLWAGLIIGYVTEYYTSNAYSPVQDVADACRTGAATNVIFGLALGYKSVIIPIFSIAVGIYVSFTVAAMYGIAVAALGMLSTIATGLSIDAYGPISDNAGGIAEMAGMSHRIRERTDALDAAGNTTAAIGKGFAIGSAALVSLALFGAFVSRAGVKVVDVLSPKVIIGLVTGAMLPYWFSAMTMKSVGRAALEMVEEVRRQFATIPGLMEGTGKPDYARCVKISTDASIRQMVPPGALVMLTPLVVGTLLGVHTLAGVLAGALVSGVQVAISASNTGGAWDNAKKYIEAGASEHARSLGPKGSDCHKAAVIGDTIGDPLKDTSGPSLNILIKLMAVESLVFAPFFAAHGGILFKLF

SEQ ID NO: 6768 - protein, 761 aa, Solanum lycopersicum
MGLMSEALTQILIPLAAIIGIGFALLQWVLVSKIRVSSGSKLESEYNNKLIEEDEQEEGIDSDDVVAKCADIQKAISQGATSFLFTEYKYLGIFMVVFGAIIFLFLGSVKSFSTESEPCTFNKENICKPALANAFFTTIAFLLGGLTSALSGFLGMKIATYANARTTLEARKSIGKAFITAFRSGAVMGFLLAANGLLVLYISINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSIGSNHDYSAMSYPLIISSMGILICLITTLIATDMFEIKNVTEIEPSLKRQLLISTVLMTVGIAFVNFFALPSEFTIFDFGSEKVVKNWHLFFCVSIGLWAGLVIGYTTEYYTSSAYSPVQEVADSCKTGAATNVIFGLALGYKSVIIPIFAIAASIYVSFSLAAMYGIAVAALGMLSTIATGLAIDAYGPISDNAGGIAEMAGMSHSIRERTDALDAAGNTTAAIGKGFAIGSAALVSLALFGAYVSRAGIKTVDVLSPKVFIGLIVGAMLPYWFSAMTMKSVGSAALKMVEEVRRQFNSIPGLMEGTAKPDYATCVKISTDASLKEMIPPGALVMLTPLIAGTFFGVETLAGVLAGSLVSGVQVAISASNTGGSWDNAKKYIEAGATEHARSLGPKGSDAHKAAVIGDTVGDPLKDTSGPSLNILIKLMAVESLVFAPFFATHGGLLFKLL

SEQ ID NO: 6769 - protein, 756 aa, Euphorbia peplus
MAVLSEGLTQIVIVLSSVVGIVFALIQWYLVSKVKVSGESENGFHDSLIAEEEDGTNNDEASIKCAEIQNAISVGATSFLFTEYKYLSIFTGIFSIIIFLFLGSVKGFSTQSEPCTYNKGNICKPALANAFFTTLAFLLGAITSVLSGFLGMKIATYANARTTLQARRGVGHAFITAFRSGAVMGFLLAANGLLVLFVTISLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGISHDYTAMLYPLIISSMGIVVCLITTLFATDLFEIKNVNEIEPSLKRQLLISTILMTAGIAMVSFLALPSEFTLFDFGTEKAVKNWHLFFCVSIGLWAGLVIGYTTEYYTSNAYSPVQDVADSCRTGAATNVIFGLALGYKSVIIPIFAIAVAIYVSFSMAAMYGISVAALGMLSTIATGLAIDAYGPISDNAGGIAEMAGMSRKIRERTDALDAAGNTTAAIGKGFAIGSAALVSLALFGAFVSRAGIKSVDVLTPKVFIGLLVGAMLPYWFSAMTMKSVGSAALKMVEEVRRQFNTIPGLMEGRVKPDYANCVKISTDASLREMIPPGALVLLSPLIAGTFFGVETLSGLLAGSLVSGVQVAISASNTGGAWDNAKKYIEAGVSEHAKSLGPKGSDAHKAAVIGDTVGDPLKDTSGPSLNILIKLMAVESLVFAPFFAAHGGLLFKL

SEQ ID NO: 6770 - protein, 667 aa, Cleome spinosa
MVGFAILIFLFLGSVEGFSSKSQPCTYDKTRMCKPALATAAFSTISFLLGAVTSLLSGFLGMKIATYANARTTLEARKGVGKAFITAFRSGAVMGFLLAANGLLVLYIAINLFKLYYGNDWEGLFEAITGYGLGGSSMALFGRVGGGIYTKAADVGADLVGKVERNIPEDDPRNPAVIADNVGDNVGDIAGMGSDLFGSYAESSCAALVVASISSFGLDHDFTAMCYPLLISSMGILVCLITTLFATDFFEIKAVKEIEPALKWQLIISTAIMTIGIAIVTWVGLPSSFTIYNFGTQKVVKNWQLFLCVGVGLWAGLIIGFVTEYYTSNAYSPVQDVADSCRTGAATNVIFGLALGYKSVIIPIFAIAASIFVSFSFAAMYGIAVAALGMLSTIATGLAIDAYGPISDNAGGIAEMAGMSHRIRERTDALDAAGNTTAAIGKGFAIGSAALVSLALFGAFVSRAAIQTVDVLTPKVFIGLLVGAMLPYWFSAMTMKSVGSAALKMVEEVRRQFNTIPGLMEGTAKPDYATCVKISTDASIKEMLPPGALVMLTPLIVGTLFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGLLFKIF

SEQ ID NO: 6771 - protein, 682 aa, Malus domestica
RSNLVPLHGIQICRCFHGCFCNLDLPFLGSVEGFSTSSRACTYDQTKMCKPALATAIFSTISFLLGAVTSVVSGFLGMKIATYANARTTLEARKGVGKAFITAFRSGAVMGFLLASSGLLVLYIAINVFKLYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGINHELTAMLYPLIVSSIGILVCLLTTLFATDFFEIKAVKEIEPTLKRQLIISTVLMTVGVAIATWISVPSSFTIFNFGTQKVVKNWQLFLCVCVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAGIKTVDVLTPKVIIGLLVGAMLPYWFSAMTMKSVGSAALKMVEEVRRQFNTIPGLMEGTAKPDYATCVKISTDASIKEMIPPGALVMLTPLIVGIFFGVETLAGVLAGSLVSGVQIAISASNTGGAWDNAKKYIEAGASEHARTLGPKGSECHKAAVIGDTIGDPLKDTSGPSLNILIKLMAVESLVFAPFFATHGGLLFKI

SEQ ID NO: 6772 - protein, 672 aa, Lippia dulcis
MWVFSMLLLSILIFLFLGSVEGFSTKSQFCTYDKEKLCKPALATAIFSTVSFLLGAVTSLISGFLGMKIATYANARTTLEARKGVGKAFITAFRSGAVMGFLLAANGLLVLYITINLFKIYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGMTLDFTAMCYPLLISSMGILVCLITTLFATDFFEIKAVKEIEPALKNQLIISTALMTVGIAIVTWTCLPSSFTIFNFGTQKVVKNWQLFLCVCVGLWAGLIIGFVTEYYTSNAYSPVKDVADSCRTGAATNVIFGLALGYKSVIIPIFAIAVSIFVSFTFAAMYGIAVAALGMLSTIATGLAIDAYGPISDNAGGIAEMAGMSHKIRERTDALDAAGNTTAAIGKGFAIGSAALVSLALFGAFVSRANISTVDVLTPKVFIGLIVGAMLPYWFSAMTMKSVGSAALKMVEEVRRQFNTIPGIMEGLSKPDYATCVKISTDASIKEMIPPGALVMLTPLIVGTFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 6773 - protein, 689 aa, Pennisetum glaucum
SGAISEGATSFLFTEYQYVGIFMSIFAVVIFLCLGSVEGFSTKSQPCTYSKGKYCKPALFTALFSTASFLLGAITSLVSGFLGMKIATYANARTTLEARKGVGKAFIVAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEIKAVKEIEPALKKQLIISTALMTVGIAIISWLALPAKFTIFNFGAQKEVSNWGLFFCVSIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTGKPDYATCVKISTDASIKEMIPPGALVMLTPLIVGTLFGVETLSGVLAGALVSGVQIAISASNTGGAWDNAKKYIEAGASDHAKSLGPKGSDCHKAAVIGDTIGDPLKDTSGPSLNILIKLMAVESLVFAPFFATHGGLIFKYL

SEQ ID NO: 6774 - protein, 722 aa, Platanus occidentalis
SVSGVNNGCKEKLLEDEEENIDGHDVVVKCAEIQNAISVGATSFLFTQYKYLSVFVVVFSAIIFLFLGSVKGFSTESEPCTYNKESLCKPALANAIFTTIAFLLGALTSVLSGFLGMKIATFANARTTLEARKGVGKAFITAFRSGAVMGFLLAANGLLVLYIAINLFRFYYGNDWEGLYESITGYGLGGSSMALFGRVGGGIYTKAADVGADLVGKVERNIPEDDPRNPAVIADNVGDNVGDIAGMGSDLFGSYAESTCAALFVASISSFGINHDFTAMSYPLIISSVGIVVCLITTLFATDLFEIKEVTQIEPSLKQQLLISTILMTVGIAIVSFVALPSQFTLFNFGKEKTVKNWYLFICVSIGLWAGLVIGYTTEYYTSNAYSPVQDVADSCRTGAATNVIFGLALGYKSVIIPIFAIAVAIYVSFSLGAMYGIAMSALGMLSTISTGLAIDAYGPISDNAGGIAEMAGMSHKIRERTDALDAAGNTTAAIGKGFAIGSAALVSLALFGAFVSRAGIKAVDVLTPKVFIGLIVGAMLPYWFSAMTMKSVGSAALKMVEEVRRQFNTIPGLMEGRAKPDYANCVKISTDASLKEMIPPGALVMLTPLIAGTFFGVETLAGVLAGSLVSGVQVAISASNTGGAWDNAKKYIEAGASEHARSLGPKGSDPHKAAVIGDTIGDPLKDTSGPSLNILIKLMAVESLVFAPFFATHGGILFKWL

SEQ ID NO: 6775 - protein, 663 aa, Cephalotaxus harringtonia
FAVIIFLFLGSVEKFSTKSQPCTYNKDVMCKPALANALFSTVSFLLGSLTSALSGYLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGTSHEFTAMCYPLLISSMGIIVCLITTLFATDIFEIKAVKEIEPALKKQLIISTVLMTIGIAVVSFVALPSSFTIFNFGEQKVVKNWHLFFCVAVGLWAGLVIGFVTEYYTSNAYSPVQDVADSCRTGAATNVIFGLALGYKSVIIPIFAIAVSIFVSFSLAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGLAKPDYATCVKISTDASLKEMIPPGCLVMLTPLIVGTFFGVETLAGVLAGALVSGVQVAISASNTGGAWDNAKKYIEAGASEHARTLGPKGSDPHKAAVIGDTIGDPLKDTSGPSLNILIKLMAVESLVFAPFFAVHGGLFFKI

SEQ ID NO: 6776 - protein, 189 aa, Vitis vinifera
MVLWVFGYGSLIWKAGFEYDDRRVCFIKGYRRVFYQGSTDHRGTPEYPGRTVTLEPAEGEICWGVAYKVSKEEDEQIALTYLEVREKQYDKKAYLDVYAEPMATTPVISGVMVYIASPDKKLNRNYLGPASVEEIAKQIIHAEGPSGPNREYLFQLEQALLQMGCEDKHVMDLANEVRRILSEKELTVS

SEQ ID NO: 6777 - protein, 189 aa, Unknown
  Sequence found in Organisms: Citrus sinensis, Citrus clementina
MAMWVFGYGSLIWKAGFHFDERVVGFIKGYRRVFHQGSTDHRGTPKFPGRTVTLEPAEGEVCWGAAYKITKKEDKEVAVTYLEVREKQYDKKAYLDLFTDPMATTPAVSGVMVYIASANKQLNSNYLGPASLEDIAKQIIQAEGPSGPNRDYLFQLEKALLELGCEDKHVIDLANTVRRILSEEDSASK

SEQ ID NO: 6778 - protein, 185 aa, Lotus japonicus
MVMWVFGYGSLITKAGFKYDERLVGFIKDYRRVFYQGSTDHRGTPEFPGRTVTLEPAEGEICWGAAYKISNKEDQEIALTYLEVREKQYDKKEYVDVFTEVNATTPAISGALVYIASPNKKVNVNYLGPASVEDIARQVVQAEGPTGPNREYLFLLEKALLQIGCKDKHVIDLANEVRRIISEEP

SEQ ID NO: 6779 - protein, 185 aa, Medicago truncatula
MAIWVFGYGSLISKAGFNYDERLVGFIKDYRRVFYQGSTDHRGTPEFPGRTVTLEPAQGEICWGAAYKITKKEDQEIALTYLGVREKQYDRKEYVDVFTELTATTPAISGALVYIASPDKKVNVNYLGPASVEEIARQIVQAEGPTGPNREYLFLLEKALLQIGCQDKHVIDLANEVRRILSEEQ

SEQ ID NO: 6780 - protein, 185 aa, Arachis hypogaea
MVMWVFGYGSLIWKAGFHFDERVVGFIKGYRRVFYQGSTDHRGTPEYPGRTVTLEPAEGEICWGVAYKISKKEDQEIALTYLEVREKQYDKKEYVDLFTDINATSPAITGVMVYIASPDKKVNVNYLGPASSEHIARQIIHAEGPSGPNRDYLFQLEKALLQIGCQDNHVIDLANEVRRFLSEKR

SEQ ID NO: 6781 - protein, 187 aa, Citrus sinensis
MWVFGYGSLIWKAGFHFDERVVGFIKGYRRVFHQGSTDHRGTPKFPGRTVTLEPAEGEVCWGAAYKITKKEDKEVAVTYLEVREKQYDKKAYLDLFTDPMATTPAVSGVMVYIASANKQLNSNYLGPASLEDIAKQIIQAEGPSGPNRDYLFQLEKALLELGCEDKHVIDLANTVRRILSEEDSASK

SEQ ID NO: 6782 - protein, 184 aa, Tropaeolum majus
MEMWVFGYGSLIWKAGFHYDDRLVGFIKDYRRVFYQGSTDHRGTQEYPGRTVTLEHAKGEYCWGAAYEITNKEDKEDALTYLEVREKQYDKKAYVDLFTEPTASAPAVSGVMVYIASPDKKKNPNYLGPAPIEDIAKQIANAEGPSGPNRDYLFHLEKALLQMGREDKHVTDLGNEVRRIISET

SEQ ID NO: 6783 - protein, 279 aa, Theobroma cacao
MSATSASSLILPCLNPKTLSLSNPRPISLFLFSLSHKLHAKPLFCSALQSFELLTKKSSSSRFVRNVAISSEYGQEEDLFGSDDGEEAPSFSPDLKLFVGNLPFSVDSAQLAGLFESAGNVEMVEVIYDKVTGRSRGFGFVTMSTAEEVEAAAQQFNGYELEGRALRVNSGPPPPRREEFSPRGSRGAPALGASNRVYVGNLSWGVDDLALETLFSEQGKVVEAKVVYDRESGRSRGFGFVTYNSAEEVDSAIKSLNGVDLDGRPIRVSVAESRPRRQF

SEQ ID NO: 6784 - protein, 279 aa, Gossypium hirsutum
MSATSASSLILPSLKPKTISLPNPTPISLSPFSLSHRLHAKPLFSSALQSFTLLTKKSSSFPSNFVRNVSVSSEYGQEEGLFGSDDEEATSFSPDLKLFVGNLPFSVDSAQLAGLFGSAGNVQMVEVIYDKVTGRSRGFGFVTMSTTEEVEAAAQQFNGYELEGRALRVNSGPPPPRREEFSPRARGGSTMGASNRVYVGNLSWGVDDLALETLFSEQGKVVEAKVVYDRESGRSRGFGFVTYNSSEEVDSAVKTFNGVELDGRPIRVSVAESRPRRQF

SEQ ID NO: 6785 - protein, 678 aa, Glycine max
MSSALCFSVSPTLMHKPQDLSKDTHLTKANNKDKSCKQSLLDNKFSKRKILSSAVIGLGPALVGLSTAQPTRAEPESPAASTSSRISYSRFLQYLDEGAVKKVDLFENGTVAIAEIYNPTLEKIQRVKIQLPGLPQELIRKMKDKNVDFAAYPMEASWWPAVLDLLGNLAFPLILLGSLILRTSTNNPAGGPNLPFGLGRSKAKFEMEPNTGVTFEDVAGVDEAKQDFQEIVEFLKTPEKFSAVGAKIPKGVLLVGPPGTGKTLLAKAIAGEAGVPFFSLSGSEFIEMFVGVGASRVRDLFNKAKQNSPCLIFIDEIDAVGRQRGTGIGGGNDEREQTLNQLLTEMDGFTGNTGVIVIAATNRPEILDSALLRPGRFDRQVTVGLPDVRGREEILKVHSNNKKLDKDVSLSVIAMRTPGFSGADLANLMNEAAILAGRRGKDKITMKEVDDSIDRIVAGMEGTKMTDGKSKILVAYHEIGHAVCATLTPGHDPVQKVTLVPRGQARGLTWFISGEDPSLISKKQLFARIVGGLGGRAAEEVIFGETEITTGAAGDLQQVTQIARQMVTVFGMSEIGPWALTDPAVQSSDVVLRMLARNSMSEKLAEDIDNSVSQIIEAAYEIAKNHIRNNRDAIDKLVDVLLEKETLSGDEFRAILSEFTDISSIKIDRIPIRELIEA

SEQ ID NO: 6786 - protein, 678 aa, Glycine max
MSSALCFSVSPTLMHKPQDLSKDTHLTKANNKDKSCKQSLLDNKFSKRKILSSAVIGLGPALVGLSTAQPTRAEPESPAASTSSRISYSRFLQYLDEGAVKKVDLFENGTVAIAEIYNPTLEKIQRVKIQLPGLPQELIRKMKDKNVDFAAYPMEASWWPAVLDLLGNLAFPLILLGSLILRTSTNNPAGGPNLPFGLGRSKAKFEMEPNTGVTFEDVAGVDEAKQDFQEIVEFLKTPEKFSAVGAKIPKGVLLVGPPGTGKTLLAKAIAGEAGVPFFSLSGSEFIEMFVGVGASRVRDLFNKAKQNSPCLIFIDEIDAVGRQRGTGIGGGNDEREQTLNQLLTEMDGFTGNTGVIVIAATNRPEILDSALLRPGRFDRQVTVGLPDVRGREEILKVHSNNKKLDKDVSLSVIAMRTPGFSGADLANLMNEAAILAGRRGKDKITMKEVDDSIDRIVAGMEGTKMTDGKSKILVAYHEIGHAVCATLTPGHDPVQKVTLVPRGQARGLTWFISGEDPSLISKKQLFARIVGGLGGRAAEEVIFGETEITTGAAGDLQQVTQIARQMVTVFGMSEIGPWALTDPAVQSSDVVLRMLARNSMSEKLAEDIDNSVSQIIEAAYEIAKNHIRNNRDAIDKLVDVLLEKETLGGDEFRAILSEFTDISSIKIDRIPIRELIEA

SEQ ID NO: 6787 - protein, 675 aa, Citrus clementina
MSPAVSLSISHLPICKSQDIAKDTHIPKSTFRESPFHKTPTDVELSKRKLLNSTALGLLGGLSLVQPAKSAEPESPIEYTSNRMTYSRFLQYLDEGSVKKVDLFENGTVAIAEIYNQALDKIQRVKVQLPGLPQELLRKMKEKNVDFAAHPIEMNWGVSLLDFLANFGFPLLLLGSLFLRSSSVNSPGGPNLPFGLGRSKAKFEMEPNTGVTFDDVAGVDEAKQDFQEIVQFLQTPEKFAAVGAKIPKGVLLVGPPGTGKTLLAKAIAGEAGVPFFSLSGSEFIEMFVGVGASRVRDLFNKAKANSPCLVFIDEIDAVGRQRGTGIGGGNDEREQTLNQLLTEMDGFTGNSGVIVIAATNRPEILDSALHRPGRFDRQVSVGLPDIRGREQILKVHSNNKKLDKDVSLSVIAMRTPGFSGADLANLMNEAAILAGRRGKANITLKEIDDSIDRIVAGMEGTKMTDGKNKILVAYHEIGHAVCATLTPGHDPVQKVTLIPRGQARGLTWFLPEEDPALISKQQLFARIVGGLGGRAAEEVIFGEAEITTGAAGDLQQITQIARQMVTRYGMSEIGPWTLIDPSVQSSDVVMRMLARNSMSEKLADDIDKTVRNIIESAYEVAKNHIRNNREAIDKLVDVLMEKETLSGDEFRAVLSEFTDVSADQVDRTPIREFAL

SEQ ID NO: 6788 - protein, 675 aa, Citrus sinensis
MSPAVSLSISHLPICKSQDVAKDTHIPKSTFRESPFHKTPTDVKLSKRKLLNSTALGLLGGLSLAQPAKSTEPESPIEYTSNRMTYSRFLQYLDEGSVKKVDLFENGNVAIAEIFNQALDKIQRVKVQLPGLPQELLRKMKEKNVDFAARPMEMNWGVSLLDFLANFGFPLLLLGSLFLRSSSVNSPGGPNLPFGLGRSKAKFEMEPNTGVTFDDVAGVDEAKQDFQEIVQFLQTPEKFAAVGAKIPKGVLLVGPPGTGKTLLAKAIAGEAGVPFFSLSGSEFIEMFVGVGASRVRDLFNKAKANSPCLVFIDEIDAVGRQRGTGIGGGNDEREQTLNQLLTEMDGFTGNSGVIVIAATNRPEILDSALHRPGRFDRQVSVGLPDIRGREQILKVHSNNKKLDKDVSLSVIATRTPGFSGADLANLMNEAAILAGRRGKANITLKEIDDSIDRIVAGMEGTKMTDGKNKILVAYHEIGHAVCATLTPGHDPVQKVTLIPRGQARGLTWFLPEEDPALISKQQLFARIVGGLGGRAAEEVIFGEAEITTGAAGDLQQITQIARQMVTRYGMSEIGPWTLIDPSVQSSDVVMRMLARNSMSEKLADDIDKTVRNIIESAYEVAKNHIRNNREAIDKLVDVLMEKETLSGDEFRAVLSEFTDVSADQVDRTPIREFAL

SEQ ID NO: 6789 - protein, 672 aa, Solanum lycopersicum
MSTALSLSVSQFPLCKSQDFSKDVYNPKISNKETPCQKTHSDTRINRRKLLSTSGLSLVAGTLSKPARAETEAPVEVTSSRMSYSRFLDYLNQGAVKKVDFFENSAVAEILINPALNKVQRVKIQLPGLPPELVRKLKDKNVDFAAHLPEKNVIGPLLDLLGNLAFPLILLGYLLLRSSSNTPGGPNLPFGLGRSKAKFQMEPNTGVTFDDVAGVNEAKQDFQEIVEFLKTPEKFAAVGAKIPKGFLLVGPPGTGKTLLAKAIAGEAGVPFFSLSGSEFIEMFVGVGASRVRDLFNKAKQNSPCIIFIDEIDAVGRQRGTGIGGGNDEREQTLNQLLTEMDGFTGNTGVIVIAATNRPEILDQALLRPGRFDRQVTVGLPDIRGREEILKVHSNNKKLDKDVSLSVIAMRTPGFSGADLANLMNEAAILAGRRGKDKITSKEIDDSIDRIVAGMEGTTMTDGKNKILVAYHEVGHAVCATLTPGHDAVQKVTLIPRGQARGLTWFIPGEDPTLISKKQLFARIVGGLGGRAAEEIIFGEPEITTGAAGDLQQITQIARQMVTMFGMSEIGPWALTDPAAQSGDVVLRMLARNQMSEKLAEDIDESVRHIIERAYEIAKNHIRNNREAIDKLVDVLLEKETLTGDEFRAILSEFTDIPFVNINRKPIRELIEA

SEQ ID NO: 6790 - protein, 683 aa, Eucalyptus grandis
MSPALSLSLSHLPPCKSQDGIPKESPHPRISAASQNPCQKSCSDASVGRRKLLATVASTGLGLGTSFLRPARAEPQSLIESASSRMSYTRFLQYLDEGAVRKVDLFENGTVAIAEIYNPALDKVQRVKVQLPGLPQELLRKMEDKNVDFAAHPMEASMWPAILDLLGNLAFPLILLGSLLLRSSSWNNPAGPNLPFGLERSKAKFQMEPNTGITFDDVAGVDEVKQDFQEIVEFLRTPEKFAAVGARIPKGVLLVGPPGTGKTLLAKAIAGEAGVPFFSLSGSEFIEMFVGVGTSRVRDLFNKAKANSPCLVFIDEIDAVGRQRGTGIGGGNDEREQTLNQLLTEMDGYSGNSGVIVIAATNRPEILDSALLRPGRFDRQVSVGLPDIRGREEILKVHSKNKKLDKDVSLSVIAMRTPGFSGADLANLMNEATILAGRRGKDKITLKEVDDSIDRIVAGMEGTKMVDGKNKMLVAYHEVGHAICATLTPGHDPVQKVTLIPRGQARGLTWFLPGEDPTLISKQQLFARIVGGLGGRAAEEVIFGEPEITTGAAGDLQQITQIARQMVITYGMSNIGPWALIEPTVQSSDVVLRMLARNSMSEKLAEDIDSSVKNIIDNAYEIAKAHIRNNREAMDKIVDLLLEKETLTGDEFRAMLSEFTDVSINNTKRTPVREMIEALETQS

SEQ ID NO: 6791 - protein, 672 aa, Solanum phureja
MSTALSLSVSQFPLCKSQDFSKDTYNPKISNKETPCQKTHSDTRINRRKLLSTGGLSLVAGTLSKTARADTEAPVEVTSSRMSYSRFLDYLNQGAVKKVDFFENSAVAEILINPALNKVQRVKIQLPGLPPELVRKLKDKNVDFAAHLPEMNVIGPLLDLLGNLAFPLILLGYLLLRSSSNTLGGPNLPFGLGRSKAKFQMEPNTGVTFDDVAGVNEAKQDFQEIVEFLKTPEKFAAVGAKIPKGFLLVGPPGTGKTLLAKAIAREAGVPFFSLSGSEFIEMFVGVGASRVRDLFNKAKQNSPCIIFIDEIDAVGRQRGTGIGGGNDEREQTLNQLLTEMDGFTGNTGVIVIAATNRPEILDQALLRPGRFDRQVTVGLPDIRGREEILKVHSNNKKLDKDVSLSVIAMRTPGFSGADLANLMNEAAILAGRRGKDKITSKEIDDSIDRIVAGMEGTTMTDGKNKILVAYHEVGHAVCATLTPGHDAVQKVTLIPRGQARGLTWFIPGEDPTLISKKQLFAIIVGGLGGRAAEEIIFGEPEITTGAAGDLQQITQIARQMVTMFGMSEIGPWTLTDPAAQSGDVVLRMLARNQMSEKLAEDIDESVRHIIERAYEIAKNHIRNNREAIDKLVDVLLEKETLTGDEFRAILSEFTDIPSANINSKPIRELIEA

SEQ ID NO: 6792 - protein, 709 aa, Manihot esculenta
MSPALSLSISHIPICKSQDLSKDAHISKISGRENPSHKTSSDVKLSKRKLLNATAFGLLSEGISIAQPAKAEPESPVAATSSRMSYSRFLQYLDEGAVRKVDLFENGTVAIAEIFNPTLSKMQRVKIQLPGLPQELLRKLKDKNVDFAAHPLEINWGAALLDLLGNLAFPLILLGSLLLRSSSTNPDGGPNLPFGLGRSKAKFQMEPNTGVTFNDVAGVDEAKQDFQEIVEFLKTPEKFAAVGARIPKGVLLVGPPGTGKTLLAKAIAGEAGVPFFSLSGSEFIEMFVGVGASRVRDLFNKAKANSPCLVFIDEIDAVGRQRGTGIGGGNDEREQTLNQLLTEMDGFSGNSGVIVIAATNRPEILDSALLRPGRFDRQVTVGLPDIRGREEILQVHSKGKNLDKDVSLSVIAMRTPGFSGADLANLMNEAAILAGRRGKGKITLKEIDDSIDRIVAGMEGTKMTDGKSKILVAYHEVGHAVCATLTPGHDPVQKVTLIPRGQARGLTWFMPGEDPTLISKQQLFARIVGGLGGRAAEEVIFGESEITTGAAGDLQQITQIARQMVTMFGMSEIGPWALTDPAVQSSDVVLRMLARNSMSEKLAKDIDSAVRDIIERAYKIAKEHVRNNREAIDKLVEVLLERETLTGDEFRAILSEFTDISVGKVDRISYSGRKLPYILSMTVEIKALVPENQTYAYALKALELELGET

SEQ ID NO: 6793 - protein, 678 aa, Fragaria vesca
MSPALSLSLSLSPVCNAQEVSKDTHLLKNTSRETPCHKSQPNLKSSRRSLLNAASLGFIVPGTLMSNSARAEPEPESPNASTSSRLSYSRFLQYLDEGAVRKVDLFENGTVAIAEIFNPTLEKLQRVRVQLPGLPQELLRKLKEKNIDFAAHPKEVDWWPAVLDLLGNFAFPLLLLGSLLLRSSSSNMPGGPNLPFGLGRSKAKFQMEPNTGVTFDDVAGVDEAKQDFQEIVEFLRTPEKFAAVGARIPKGVLLVGPPGTGKTLLAKAIAGEAGVPFFSLSGSEFIEMFVGVGASRVRDLFNKAKDNSPCLVFIDEIDAVGRQRGTGIGGGNDEREQTLNQLLTEMDGFSGNSGVIVIAATNRPEILDSALLRPGRFDRQVSVGLPDIRGREEILKVHSNNKKLDKSVSIDIIAMRTPGFSGADLANLMNEAAILAGRRGKDKITAKEIDDSIDRIVAGMEGTKMTDGKSKTLVAYHEVGHAICATLTPGHDPVQKVSLIPRGQARGLTWFLPGEDPALISKQQLFARIVGGLGGRAAEEIIFGEPEITTGAAGDLQQVTQIAKQMVTMYGMSEIGPWALTDPAAQSNDLVLRMLARNTMSEKLAEDIDLSVRRIIESAYEVAKNHIRNNRAAMDQLVDVLLEKEILTGDEFRAILSEFTDTSLVEVNRNSIREMIEA

SEQ ID NO: 6794 - protein, 679 aa, Cucumis sativus
MSSTIYLSPSLSPVCKLHDHSRKTHHSKTSNKENPCPKIPLNAQISKRNLLSSTGLTLPADAFFNDSGLARAEPESPIESASSRLSYSRFLQYLDEGAVKKVDVFENGTVAIAEIYNPVLDKIQRVKIQLPGLPKELIRKMEEKNVDFAAHPMEINWGPAILDLLGNFGFPLLLLGSLLLRSSSSNSPGGPNLPFGLGRSKAKFQMEPNTGVTFDDVAGVDEAKQDFQEIVEFLKTPEKFSAVGARIPKGVLLVGPPGTGKTLLARAIAGEAGVPFFSLSGSEFIEMFVGVGASRVRDLFNKAKANSPCLVFIDEIDAVGRMRGTGIGGGNDEREQTLNQLLTEMDGFTGNSGVIVIAATNRPEILDSALLRPGRFDRQVTVGLPDVRGREEILKVHSNNKKLDSNILLSVIAMRTPGFSGADLANLMNEAAILAGRRGKDKITLKEIDDSIDRIVAGMEGTTMTDGKSKILVAYHEIGHAVCATLTEGHDQVQKVTLIPRGQARGLTWFLPGEDPTLVSKKQLFARIVGGLGGRAAEDVIFGEPEITTGAAGDLLQVTQIARQMVTTLGMSEIGPWTLIDPAVQSSDVVMRMLARNSMSEKLAEDIDSSVRNTIAKAYEIAKTHIRNNREAIDKLVDVLLEKETISGDEFRSILSEFTNIPSDNGIQTSSSIPQLVKA

SEQ ID NO: 6795 - protein, 645 aa, Theobroma cacao
  misc_feature (145)..(145): Xaa can be any naturally occurring amino acid
  misc_feature (240)..(240): Xaa can be any naturally occurring amino acid
  misc_feature (366)..(366): Xaa can be any naturally occurring amino acid
MPALVNYGGDDDFYSGGSFYTNSTDLGRLCSISSQVDVYCPPRKRARICAPFLFGETEFEQNKQPSIDVLPEECLFEIFKRLPGGRERSSCACVSKHWLMLLTSIRKSEYESSKVVKENTDLVSEDVEMISSDEDDGYLTRCLEXKKATDMRLAAVAVGTSGHGGLGKLSIRGSSSSCGVTNFGLSAIARGCPSLKALSLWNIPCVGDEGLSEIAKECHLLEKLDLCQCPLVSNKGLIAXAENCPNLTSLSIESCPKIGNEGLQAIGKLCPKLQSISIKDCPLVGDHGVSSLLASASSVLSKVKLQGLNITDFSLAVIGHYGKSVTNLMLSGLQNVSEKGFWVMGNAQGLQKLASLMITSCWGVTXVSLEAMGKGCTNLKQMCLRRCCFLSDDGLVAFAKSAGSLECLQLEECNRVTQSGIIRVLSNCGLKSLTLVKCLGIKDMSLGAPLSSTCNSLKSLSVRNCPGFGTASLAMVGKLCPQLQHVDLSGLYGITDAGLLPLLESCEAGLVKVNLSGCLNLTDEVVLALTRLHGGTLELLNLDGCRRITDASLVAVADNCVFLSDLDVSRCAITDSGVAALSHAEQLNLQVLSFSGCSGVSNKSMPFLKKLGKTLVGLNLQHCNSISSRTVELLVESLWRCDTLF

SEQ ID NO: 6796 - protein, 692 aa, Theobroma cacao
MHSSFQGLYLVCLFLAFCAVGFCVLGLEASQKSFFFEIQPCLLLLITVILFIGISGDDDFYSGGSFYTNSTDLGRLCSISSQVDVYCPPRKRARICAPFLFGETEFEQNKQPSIDVLPEECLFEIFKRLPGGRERSSCACVSKHWLMLLTSIRKSEYESSKVVKENTDLVSEDVEMISSDEDDGYLTRCLEGKKATDMRLAAVAVGTSGHGGLGKLSIRGSSSSCGVTNFGLSAIARGCPSLKALSLWNIPCVGDEGLSEIAKECHLLEKLDLCQCPLVSNKGLIAIAENCPNLTSLSIESCPKIGNEGLQAIGKLCPKLQSISIKDCPLVGDHGVSSLLASASSVLSKVKLQGLNITDFSLAVIGHYGKSVTNLMLSGLQNVSEKGFWVMGNAQGLQKLASLMITSCWGVTDVSLEAMGKGCTNLKQMCLRRCCFLSDDGLVAFAKSAGSLECLQLEECNRVTQSGIIRVLSNCGLKSLTLVKCLGIKDMSLGAPLSSTCNSLKSLSVRNCPGFGTASLAMVGKLCPQLQHVDLSGLYGITDAGLLPLLESCEAGLVKVNLSGCLNLTDEVVLALTRLHGGTLELLNLDGCRRITDASLVAVADNCVFLSDLDVSRCAITDSGVAALSHAEQLNLQVLSFSGCSGVSNKSMPFLKKLGKTLVGLNLQHCNSISSRTVELLVESLWRCDTLF

SEQ ID NO: 6797 - protein, 189 aa, Gossypium hirsutum
MESQNLKHRSRDDPRFATTTSNEKNRANRREKRMAMAKRGLRSLVIAVSFPLSLTLLNIYLFGSGRGYASLAKPFWFPPLWLLHTGCLASSFVMGLSAWFVWVEGGFHVKPTALSLYLGYLGLSMAWHPTVLWMGASWAGLLVSLAMVGTLVGCSRDFGKVNPIAGNSVMPCLAWAAFLATVNLKLVFL

SEQ ID NO: 6798 - protein, 152 aa, Theobroma cacao
MSRVADTMNHWLSFPENIGKLMFSSRTQDTHDNENKGFSSIPADILDTPKEFIFFLDVPGLSKTDIQVTVENEHTLVIKSGGKRKREEVEEEGCKYIRLERKPPQKRMRKIRLPENANASAITAKCENGVLTVVVEKLPPPPKPKTVEVAIA

SEQ ID NO: 6799 - protein, 152 aa, Theobroma cacao
  misc_feature (126)..(126): Xaa can be any naturally occurring amino acid
MSRVADTMNHWLSFPENIGKLMFSSRTQDTHDNENKGFSSIPADILDTPKEFIFFLDVPGLSKTDIQVTVENEHTLVIKSGGKRKREEVEEEGCKYIRLERKPPQKRMRKIRLPENANASAITAKXENGVLTVVVEKLPPPPKPKTVEVAIA

SEQ ID NO: 6800 - protein, 152 aa, Heritiera littoralis
MSRVADTMNHWFSFPESIEKFMFQSRTQDSHENENKGFSSIPVDILDTPKEFIFCLDVPGLSKSDIQVTVENETILVIKSGGKRKRDEVEEEGCKYIRLERKPPQKLMREFRLPENANVSAITAKCENGVLTVVVEKLPPPPKPKTVEVAID

SEQ ID NO: 6801 - protein, 617 aa, Ricinus communis
MDSDFGIPRELSDLQKLRSLYQPELPPCLQGTTVRVELGDGTTAADEAGAHTISRSFPHTYGQPLAHFLRATAKVADAHIISEHPAMRVGVVFCGRQSPGGHNVVWGLHNALKIHNPNSTLLGFLGGSEGLFAQKTLEVTDDILSTYKNQGGYDLLGRTKDQIRTTEQVHAALTTCKNLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNMVILGEEVAASKLTLFDLTKQVCDAVQARAEQDKYHGVILLPEGLIESIPEVYALLKEIHGLLRQGVSPNNISSQLSPWASALFEFLPPFIKKQLLLYPESDDSAQLSQIETEKLLAHLVEAEMNKRLKEGTYKGKKFNAICHFFGYQARGSLPSKFDCDYAYVLGHICYHVLAAGLNGYMATATNLKNPVNKWRCGAAPIAAMMTVKRWAQNPGATSIGKPAIHPAAVDLKGKAYELLRLNAVKFLMDDLYRNPGPLQFEGPGADAKPITLCVEDQDYMGRIKKLQEYLDKVRTIVKPGCSQEVLKAALSVMASVTDVLLTMSSTSLDGQRPL

SEQ ID NO: 6802 - protein, 613 aa, Tropaeolum majus
MDSDFGIPRELSDLQKHRSLYQPDLPPCLQGTTVRVEFGDSTTPIDPADAHNIARAFPHTYGHPLAHFLRANANVPDAQIITEHPEKRVGIVFSGRQSPGGHNVIWGLHEALKIHNPKSTLLGFLGGSEGLFAQKTLEITDDILSFYKNQGGYDLLGRTKDQIRTTEQVNAALSACNNLKLDSLVIIGGVTSNTDAAQLAETFAEANCATKVVGVPVTLNGDLRNAFVETNVGFDTICKVNSQLISNVCTDALSAEKYYYFIRLMGRKASHVALECTLQSHPNMVILGEEVAASKLTLFDLTTQICDAVQARAVQDKNHGVILLPEGLIESIPEVYALLKEIHGLLRQGVSVDMISSQLSPWASALFEFLPAFIRKQLVLYPESDDSAQLSQIETEKLLAYLVETEMNKRLKEGTYKGKKFNAICHFFGYQARGSLPSKFDCDYAYVLGHICYHVLAAGLNGYMATVTNLKNPVNKWKCGAAPISAMMTVRRWSQNPGATMIGKPAIHPATVDLKGRAYDLLKQNAQKFLLDDLYRNPGPLQFDGPGADAKPVTLCVEDQDYMGRIKKLQEYLDKVKTIVKPGCSQEVLKAALSVMGSVTEVLTVMSSSSGHL

SEQ ID NO: 6803 - protein, 615 aa, Unknown
  Sequence found in Organisms: Citrus sinensis, Citrus clementina, Citrus sinensis
MDSDFGIPRELSGLQQLRSLYQPELPPCLQGTTVRVEFGDSTTTADPADTHSISRSFPHTYGQPLAHFLRATAKVPDAQIITEHPAIRVGIVFCGRQSPGGHNVVWGLYDALKLHNPKSTLLGFLGGSEGLFAQKTLEVTKEILSTYKNQGGYDMLGRTKDQIRTTEQVNAALTACKNLNLDGLVIIGGVTSNTDAAYLAETFAEAKCPTKVVGVPVTLNGDLKNQFVETNVGFDTICKVNSQLISNVCTDALSAEKYYYFIRLMGRRASHVALECTLQSHPNMVILGEEVAASKLTLFDLTKQICDAVQARAEQDKNHGVILLPEGLIESIPEVYALLKEIHSLLRQGVPVDNISSQLSPWASALFEFLPPFIKKQLLLQPESDDSAQLSQIETEKLLAHLVEVEMNKRLKEGTYKGKKFNAICHFFGYQARGSLPSKFDCDYAYVLGHICYHILAAGLNGYMATVTNLKNPANKWRCGAAPITSMMTVKRWSQNPGASSIGRPAINPATVDMRGKAYELLRQNATRFLLDDLYRNPGPVQFDGPGADAKAVTLCVEDRDYMGRIKELQKYLDEVRTIVKPGCSQEVLKAALSVMASVTEVLSAMSASGGQTTL

SEQ ID NO: 6804 - protein, 617 aa, Populus trichocarpa
MDSDFGIPRELSDLQKLRSLYQPELPPCLQGTAVRVELGDATTAADPADVHSISRSFPLTYGQPLAHFLRASAKVSDAQIITDHPAFRVGIVFCGRQSPGGHNVIWGLHNALKIHNPNSTLLGFLGGSEGLFAQKTLEITDDILSTYKNQGGYDLLGRTKDQIRTTEQVNAALTACKDLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNMVILGEEVAASKLTLFDLTTQICDAVQARAVQDKNHGVILLPEGLIESIPEVYALLKEIHGLLRHGVAPDNISSQLSPWTSALFEFLPPYIKKQLLLHPESDDSAQLSQIETEKLLAHLVETEMNKRLKEGTYTGKKFNAICHFFGYQARGSLPSKFDCDYAYVLGHISYHILAAGLNGYMATVTNLKNPVNKWRCGAAPITAMMTVKRWAQSPGASSIGKPAIHPATVDLKGKAYELLRQNAGRFWMDDLYRNPGPLQFDGPGADSKAVTLCVEDQDYMGGIKKLQEYLDKVRNIVKPGCSQEVLKAALSVMSSVTDVLSVMSSTSSNGQTPL

SEQ ID NO: 6805 - protein, 616 aa, Vitis vinifera
MDSDFGIPRELSDLQKHRCLYEPELPPCLQGTTVRVEFGDATTASDLSGARTISRSFPHTYGQPLAHFLRATAKVPDAQVITEHPPIRVGVVFCGRQSPGGHNVIWGLHNALKIHNPKNILLGFLGGSEGLFAQKTLEITDDILSTYKNQGGYDLLGRTKDQIRTTEQVNAALSTCKNLKLEGLVIIGGVTSNTDAAQLAETFAEAKCQTKVVGVPVSLNGDLKNQFVESNVGFDTICKVNSQLISNVCTDALSAEKYYYFIRLMGRKASHVALECTLQSHPNMVILGEEVAASKLTLFDLTKQICDAVQARAEQDKYHGVILLPEGLIESIPEVYALLQEIHGLLRQGVSAVNISSKLSPWASALFEFLPPFIKKQLLLYPESDDSAQLSQIETEKLLAHLVEAEMNKRLKEGTYKGKKFNAICHFFGYQARGSLPSKFDCDYAYVLGHICYHVLAAGLNGYMATVTNLKNPVNKWRCGAAPITAMMTVKRYSRGPGTSSIGKPAVHPYALDLKGKAYELLSQNATKFLLDDLYRNPGPLQFDGPGADAKAVTLCVEDQDYMGRIKKLQQYLDKVRTIVKPGCSQDVLKAALSAMASVTEILSVMTSPSSGQTPL

SEQ ID NO: 6806 - protein, 618 aa, Silene vulgaris
MDSDFGIPRELSDLQKQRSLYHPELPPCLQGTTVRVEYGDTTTSLDPSDAHAISRYFPHTYGQPLAHFLRETAKVADAKIITEHPAIRVGLVFSGRQSPGGHNVIWGLYNALKTHNENNVLLGFLGGTEGLFAQKTLEISDDILSTYKNQGGYDLLGRTKDQIRTTEQVNAALASCKALKLDGLVIIGGVTSNTDAAQLAETFADAKCATKVVGVPVTLNGDLKNQFVEADVGFDTICKVNSQLISNVCTDALSAEKYYYFIRLMGRKASHVALECTLQSHPNMVVLGEEVAASKLTLFDVTKQICDAVQARAETDKNHGVILLPEGLIESIPEVYALLQEIHSLHREGVSIENISSQLSPWASALFEFLPPFIKKQLLLHPESDDSAQLSQIETEKLLAHLVETEMNKRLKEGTYKGKKFNAICHFFGYQARGSLPSKFDCDYAYVLGHICYHILAAGLNGYLATITNLKNPVNKWKCGAAPLTAMMTVKRYSRGPAGTLSIGKPAINPATVDLKGKAYELLRQNATRFLIEDIYRNPGPLQFDGPGADAKAVTLCVEDQDYMGRIKQLQVYLDKVRSIVKPGCSQDVLKAALSSMSSVTEILSLMSSNSNSGQRMI

SEQ ID NO: 6807 - protein, 618 aa, Fragaria vesca
MDSDYGIPRELSAVQKLRSQYQPDLPPCLQGTTVRVEFGDTTTAADPTDANTISRYFPNTYGQPLAHFLRATAKVAGAQVISEHPAMRVGIVFCGRQSPGGHNVIWGLLKALKTHNPNSTLLGFLGGSEGLFAQKTLEITDDVLATYKNQGGYDLLGRTKDQIRTKEQVNATLTACNALKLAGLVIIGGVTSNTDAAQLAETFAEAKCQTKVVGVPVTMNGDLKNQFVEANVGFDTVCKVNSQLISNMCTDALSAEKYYYFIRLMGRKASHVALECTLQSHPNLVILGEEVAASKLTLFDIATRICDAVQDRAAQDKNHGVILLPEGLIESIPEVYALLKEIHGLYRQGVSADKILSQLSPWASALFEFLPHFIKKQLLLLPESDDSAQLSQIETEKLLAHLVEVEMNKRQKEGTYKGKKFNAICHFFGYQARGSLPSKFDCDYAYVLGHICYHMLAAGLNGYMATVTNLKNPLNKWRCGATPFTAMMSVKRWSQNPGSAASIGKPGIFPATVDLKGKAYELLRQNATKFLLDDIYRNPGPLQFEGPGADSKAVTLCVEDQDYMGRIKKLQEYLDQIRTIVKPGCSQEVLKAALSVMGSVSEVLTVMSSSSLNAPSSL

SEQ ID NO: 6808 - protein, 612 aa, Actinidia deliciosa
MDSDYGIPRELSDIQKLRSTYQPQLPPCLQGTTVRVEFGDATTAEDPSGAHTISRTFPHTYGQPLVHFLRATAKVPDAQIITFHPAIRVGVVFCGRQSPGGHNVIWGLHNALKIHNPNSALVGFLGGSEGLFAQRTLEITDDILATYKNQGGYDLLGRTKDQIRTTEQVNSALAACIALKLDGLVIIGGVTSNTDAAQLAETFAVEKCPTKVVGVPVTLNGDLKNQFVETNVGFDTTCKVNSQLISNVCTDALSAEKYYYFIRLMGRKASHVALECTLQSHPNSVILGEEVSASKLTLFDLTKQICDAVQARADQDKYHGVILLPEGLIESIPEVHALLQEIHGLLRQGVSLDNISSQLTPWASALFEFLPPFIRKQFLLFPESDDSAQLSQIETEKLLAHLVEAEINKRLKEGTYKGKKFNAICHFFGYQARGSLPSKFDCDYAYVLGHICYHILAAGLNGYLATVTNLKNPVNKWRCGAAPITAMMTVKHYGRGPGASSIGKPALHPAAVDLRGKAYELLRQNATKFLMDDVYRNPGPLQFDGPGADAKPVTLCVEDQDYMGRIKKLQEYLDKVRTIVKPGCSQDVLKAALSAMSSVTDILSVMSSFSNS

SEQ ID NO: 6809 - protein, 462 aa, Nicotiana tabacum
  misc_feature (16)..(16): Xaa can be any naturally occurring amino acid
MLGRTKDQIRSTEQVXAAMAACKTLKLDALIIVGGVTSNTDAAQLAETFTEAKCQTKVVGVPVTLNGDLKNQFVEINVGFDTICKVNSQLISNVCTDALSAEKYYYFIRLMGRKASHVALECTLQSHPNMVILGEEVAASKLTLFDITKQICDAVQARAEHDKNHGVILLPEGLIESIPEVYALLQEIHGLLRQGVSADKISSQLSPWASALFEFLPYFIRKQLLLYPESDDSAQLSQIETEKLIAHLVETEMNKRLKEGTYKGKKFNAICHFFGYQARGSLPSKFDCDYAYVLGHVSYHILAAGLNGYMATVTNLKNPVNKWHCGAAPISAMMTVKRYGRGPGKASIGVPALHPATVDLKGKSYELLSQNATKFLLDDVYRNPGPLQFDGPGADAKAVTLCVEDQDYMGRIKKLQEYLDKVRTIVKPGCSQDVLKAALSAMASVTDILSVISSPSSVNTPF

SEQ ID NO: 6810 - protein, 617 aa, Solanum lycopersicum
MDADYGIARELSDLQKLRSQYQPELPPCLQGTTVRVELGDATTAADPSGEHVISRSFPHTYGQPLAHFLRATAKVSDAQIITEHPAKRVGIVFCGRQSPGGHNVIWGIHDALKIHNPNSTLLGFLGGSEGLFAQKTLEITNDILATYKNQGGYDMLGRTKDQIRTTEQVNAAMAACKALKLDALIIIGGVTSNTDAAQLAETFAEAKCQTKVVGVPVTLNGDLKNQFVETNVGFDTICKVNSQLISNMCTDALSAEKYYYFIRLMGRKASHVALECTLQSHPNMVILGEEVSASKLTLFDITNKICDTVQARAEQDKNHGVILLPEGLIESIPEVYALLQEIHGLLKQGVSADKISSQLSPWASALFEFLPPFIKKQLLLHPESDDSAQLSQIETEKLLAHLVETEMNKRLKEGTYKGKKFNAICHFFGYQARGSLPSKFDCDYAYVLGHVCYHILAAGLNGYMATLTNLKNPVNKWRCGAAPITAMMSVKRYGRGPGKASLGKPAVHPATVDLKGKSYELLSQNATKFLLDDVYRNPGPLQFDGPGADAKAITLCVEDQDYMGRIKKLQEYLDKVRTIVKPGCSQDVLKAALSAMSSVTEILSVMASPSSNANTPF

SEQ ID NO: 6811 - protein, 617 aa, Solanum tuberosum
MDADYGIARELSDLQKLRSQYQPELPPCLQGTTVRVELGDATTAADHSGEHVISRSFPHTYGQPLAHFLRATAKVSDAQIITEHPAKRVGIVFCGRQSPGGHNVIWGIHDALKIHNPNSTLLGFLGGSEGLFAQKTLEITNDILATYKNQGGYDMLGRTKDQIRTTEQVNAAMAACKALKLDALIIIGGVTSNTDAAQLAETFAEAKCQTKVVGVPVTLNGDLKNQFVETNVGFDTICKVNSQLISNMCTDALSAEKYYYFIRLMGRKASHVALECTLQSHPNMVILGEEVAASKLTLFDITNKICDTVQARAEQDKNHGVILLPEGLIESIPEVYALLQEIHGLLTQGVSADKISSQLSPWASALFEFLPPFIKKQLLLHPESDDSAQLSQIETEKLIAHLVETEMNKRLKEGTYKGKKFNAICHFFGYQARGSLPSKFDCDYAYVLGHVCYHILAAGLNGYMATLTNLKNPVNKWRCGAAPITAMMSVKRYGRGPGKASLGKPAVHPATVDLKGKSYELLSQNATKFLLNDVYRNPGPLQFDGPGADAKAITLCVEDQDYMGRIKKLQEYLDKVRTIVKPGCSQDVLKAALSAMSSVTEILSVMTSPSSNVNTPF

SEQ ID NO: 6812 - protein, 616 aa, Solanum tuberosum
MDADYGIPRELSDLQKLRSHYHPELPPCLQGTTVRVELRDATTAADPSGEHTIKRFFPHTYGQPLAHFLRATAKVPDAQIITEHPAIRVGVLFCGRQSPGGHNVIWGLHDALKVHNPKNILLGFLGGSEGLFAQKTLEITDDVLATYKNQGGYDMLGRTKDQIRTTEQVNAAMAACKALKLDGLVIIGGVTSNTDAAHLAEKFAETKCLTKVVGVPVTLNGDLKNQFVEANVGFDTICKVNSQLISNVCTDALSAEKYYYFIRLMGRKASHVALECTLQSHPNMVILGEEVAASKLTIFDITQQICDAVQARAEHDKNHGVILLPEGLIESIPEVYALLQEIHGLLRQGVSADKISSQLSPWASALFEFLPHFIRKQLLLHPESDDSAQLSQIETEKLIAHLVETEMNKRLKEGTYKGKKFNAICHFFGYQARGSLPSKFDCDYAYVLGHVCYHILAAGLNGYMATITNLKNPANKWHCGAAPISAMMTVKRYGRGPGKASIGVPALHPATVDLRGKSYELLSQNATKFLLDDVYRNPGPLQFDGPGADAKAVSLCVEDQDYIGRIKKLQEYLDKVRTIVKPGCSQDVLKAALSAMASVTDILSVISSPSSVSTPF

SEQ ID NO: 6813 - protein, 617 aa, Solanum phureja
MDADYGIARELSDLQKLRSQYQPELPPCLQGTTVRVELGDATTAADHSGEHVISRSFPHTYGQPLAHFLRATAKVSDAQIITEHPAKRVGIVFCGRQSPGGHNVIWGIHDALKIHNPNSTLLGFLGGSEGLFAQKTLEITNDILATYKNQGGYDMLGRTKDQIRTTEQVNAAMAACKALKLDALIIIGGVTSNTDAAQLAETFAEAKCQTKVVGVPVTLNGDLKNQFVETNVGFDTICKVNSQLISNMCTDALSAEKYYYFIRLMGRKASHVALECTLQSHPNMVILGEEVAASKLTLFDITNKICDTVQARAEQDKNHGVILLPEGLIESIPEVYALLQEIHGLLTQGVSTDKISSQLSPWASALFEFLPPFIKKQLLLHPESDDSAQLSQIETEKLIAHLVETEMNKRLKEGTYKGKKFNAICHFFGYQARGSLPSKFDCDYAYVLGHVCYHILAAGLNGYMATLTNLKNPVNKWRCGAAPITAMMSVKRYGRGPGKASLGKPAVHPATVDLKGKSYELLSQNATKFLLDDVYRNPGPLQFDGPGADAKAITLCVEDQDYMGRIKKLQEYLDKVRTIVKPGCSQDVLKAALSAMSSVTEILSVMTSPSSNVNTPF

SEQ ID NO: 6814 - protein, 616 aa, Solanum lycopersicum
MDADYGIARELSDLQKLRSHYHPELPPCLQGTTVRVELRDATTAADPSGEHTIKRFFPHTYGQPLAHFLRATAKVPDAQIITEHPAIRVGVLFCGRQSPGGHNVIWGLHDALKVHNPNNILLGFLGGSEGLFAQKTLEITDDVLATYKNQGGYDMLGRTKDQIRTTEQVNAAMAACKALKLDGLVIIGGVTSNTDAAHLAEKFAETKCPTKVVGVPVTLNGDLKNQFVEANVGFDTICKVNSQLISNVCTDALSAEKYYYFIRLMGRKASHVALECTLQSHPNMVILGEEVAASKLTIFDITQQICDAVQARAEHDKNHGVILLPEGLIESIPEIYALLQEIHGLLRQGVSADNISSQLSPWASALFEFLPHFIRKQLLLHPESDDSAQLSQIETEKLIAHLVETEMNKRLKEGTYKGKKFNAICHFFGYQARGSLPSKFDCDYAYVLGHVCYHILAAGLNGYMATITNLKNPANKWHCGAAPISAMMTVKRYGRGPGKASIGVPALHPATVDLRGKSYELLSQNATKFLLDDVYRNPGPLQFDGPGADAKAVTLCVEDQDYIGRIKKLQEYLDKVRTIVKPGCSQDVLKAALSAMASVTDILSVISSPSSVSTPF

SEQ ID NO: 6815 - protein, 616 aa, Solanum phureja
MDADYGIPRELSDLQKLRSHYHPELPPCLQGTTVRVELRDATTAADPSGEHTIKRFFPHTYGQPLAHFLRATAKVPDAQIITEHPAIRVGVLFCGRQSPGGHNVIWGLHDALKVHNPKNILLGFLGGSEGLFAQKTLEITDDVLATYKNQGGYDMLGRTKDQIRTTEQVNAAMAACKALKLDGLVIIGGVTSNTDAAHLAEKFAETKCLTKVVGVPVTLNGDLKNQFVEANVGFDTICKVNSQLISNVCTDALSAEKYYYFIRLMGRKASHVALECTLQSHPNMVILGEEVAASKLTIFDITQQICDAVQARAEHDKNHGVILLPEGLIESIPEVYALLQEIHGLLRQGVSADKISSQLSPWASALFEFLPHFIRKQLLLHPESDDSAQLSQIETEKLIAHLVETEMNKRLKEGTYKGKKFNAICHFFGYQARGSLPSKFDCDYAYVLGHVCYHILAAGLNGYMATITNLKNPANKWHCGASPISAMMTVKRYGRGPGKASIGVPALHPATVDLRGKSYELLSQNATKFLLDDVYRNPGPLQFDGPGADAKAVSLCVEDQDYIGRIKKLQEYLDKVRTIVKPGCSQDVLKAALSAMASVTDILSVISSPSSVSTPF

SEQ ID NO: 6816 - protein, 616 aa, Ocimum basilicum
MDSDYGVQRELSDLQKLRSQYQPELPPCLQGTTVRVEFGDVTTAADPLGAHTISRTFPHTYGQPLAHFLRANAKVPDAQIITEHPAVRVGVVFCGRQSPGGHNVIWGLHDAIKVHNPKSVLLGFLGGSDGLFAQRTLEITDDILSTYKNQGGYDLLGRTKDQIRTTEQVNAALNACTSLKLDALVIIGGVTSNTDAAHLAETFAERKCPTKVVGIPVTLNGDLKNQFVETNVGFDTICKVNSQLISNVCTDALSAEKYYYFIRLMGRKASHVALECTLQSHPNMIILAEEVAASKLTLFDITKQICDAVQARGEQDKYHGVILLPEGLIESIPEVYALLQEIHRLLREGVSADKISSQLSPWASALFEFLPVFIRKQLLLHPESDDSAQLSQIETEKLLAYLVEVEMNKRLKEGTYKGKKFNAICHFFGYQARGSLPSKFDCDYAYVLGSIGYHVIAAGLNGYMATVTNLKNPVNKWRCGAAPITAMLTVKRYGRGHGDTNLGRPALHPATVDLKGKAYELLRQNATKFLLDDVYRNPGPLQFDGPGADSKPVSLCVEDQDYMGRIKKLQEYLDKVRSIVKPGCSQDVLKAALSAMASVTDILSVISTPTSGNIPI

SEQ ID NO: 6817 - protein, 553 aa, Olea europaea
MDSDFGVPRELSDLQKLRSQYRPQLPPCLQGTTVRVEFGDATTVADPSGAHTISRSFPHTYGQPLAHFMRETAKAPDAQIITEHPAIRVGVVFCGRQSPGGHNLVWGLLDALKVHNPKSTLLGFLGGSEGLFAQKTLEVTDDVLATYKNQGGYDLLGRTKDQIRTTEQVNAALDACINLKLDGLVIIGGVTSNTDAAQLAETFAERKCPTKVVGVPVTLNGDLKNQFVETNVGFDTICKVNSQLISNVCTDALSAEKYYYFIRLMGRKASHVALECTLQSHPNMVILAEEVAASKLTLFDITKQICDAVQARAEQDNYHGVILLPEGLIESIPEVYALLQEIHGLLRQGVSADNISSQLSPWASALFEFLPPFIRKQLLLHPESDDSAQLSQIETEKLLVHLVEAEMNKRLKEGTYKGKKFNGICHFFGYQARGSLPSKFDCDYAYVLGHIGYHILAAGLNGYMATVTNLKNPVNKWRCGAAPITSMMTVKRYGRGHGAATLGKPALHPAAVDLKGKSYGLLRQNATKFLMDDVYTKPTDPFSSKVLGLIQSP

SEQ ID NO: 6818 - protein, 617 aa, Catharanthus roseus
MDSDYGIPRELSDLQKLRAQYKPELPPCLQGTTVRVELSDATIAADPMGAHTISRSFPHTYGQPLAHFLRPTAQVPDAQIITDHPAIRVGLVFCGRQSPGGHNVIWGLYDAIKSHNAKSTLLGFLGGSEGLFAQKTLEITDDVLATYKNQGGYDLLGRTKDQIRTTEQVNAAMAACKALKLDGLVVVGGVTSNTDAAYLAETFAEAKCTTKVVGVPVTLNGDLKNKFVETNVGFDTICKVNSQLISNVCTDALSAEKYYYFIRLMGRKASHVALECTLQSHPNMVILGEEVAASKLTLFDITKQICDAVQARSEQDKYHGVILLPEGLIESIPEVYALLKEIHVLLRQGVSADNIFSQLSPWASALFEFLPPFIRKQLLLYPESDDSAQLSQIETEKLLAHLVEEEMNKRLKEGTYKGKKFNGICHFFGYQARGSLPSKFDCDYAYVLGYICYHILAAGLNGYMATVTNLKNPLNKWRCGAAPITAMLTVKRYGRGPGAAYLGKPALHPATVDLKGKSYELLRQNATKFLLDDVYRNPGPLQFDGPGADSKAVTLCVEDQDYMGRIKQLQEYLDKVRNIVKPGCSQDVLKAALSAMSSVTDILSVISSPSNSGSTPF

SEQ ID NO: 6819 - protein, 616 aa, Plantago ovata
MDSDFGIARELSDLQELRSQYQPELPPCLQGTTVRVELGDGTTAADPSGSHTISRSFPHTYGQPIAHFLRTTAQVPDAQIITEHPATRVGVVFCGRQSPGGHNVIWGLLEALKVHNPKSALLGFLGGSEGLFAQKTLEITDDILASYKNQGGYDLLGRTKDQIRTTEQVNASLDACNALKLDALVIIGGVTSNTDAAQLAETFAERKCPTKVVGIPVTLNGDLKNQFVETNVGFDTICKVNSQLISNMCTDALSAEKYYYFIRLMGRKASHVALECTLQSHPNMVILAEEVAASKLTLFDITKQICDAVQARGEQDKNHGVILLPEGLIESIPEVYALLQEIHSLLRQGVTADNISTQLSPWASALFEFLPPFIRKQLLLQPESDDSAQLSQIETEKLFAHLVEEEMNKRLKEGTYKGKKFNAICHFFGYQARGSLPSKFDCDYAYVLGHVAYHIIAAGLNGYMATVTNLKNPVNKWKCGAAPITAMMTVQRYGRGHKALTIGKPALHPATVDLKGKAYELLRQNATKFLMDDVYRNPGPLQFEGPGADAKPVSLCVEDQDYMGRIKKLREHLDKVRSMVKPGCSQDVLKAALSAMSSVTDVLTLMSSPSSGSTPF

SEQ ID NO: 6820 - protein, 616 aa, Mimulus guttatus
MDSDYGTARELSDLQKLRSHYQPELPPCLQGTTVSVEFGDVTTAADPLGAHTISRSFPHTYGQPIAHFLRASAKVPDAQIITDHPAVRVGVVFCGRQSPGGHNVIWGLLDALKVHNPKSTLLGFLGGSEGLFAQKTLEITDQILATYKNQGGYDLLGRTKDQIRTTEQVNASLKACTTLKLDALVIIGGVTSNTDAAQLAETFAERKCPTKVVGIPVTLNGDLKNQFVETNVGFDTICKVNSQLISNVCTDALSAEKYYYFIRLMGRKASHVALECTLQSHPNMVILAEEVASSKLTLFDITKQLCDAVQARGEQDKHHGVILLPEGLIESIPEVYALLQEIHGLIKVGVSADNISAQLSPWASALFEFLPPFIRKQLLLHPESDDSAQLSQIETEKLLAHLVEAEMNKRLKEGTYKGKKFNAICHFFGYQARGSLPSKFDCDYAYVLGHIGYHIIAAGLNGYMATVTNLKNPLNKWRCAAAPITAMLTVKRYGRGHGASNLGKPALHPATVDLKGKAYELLRQNATKFLMDDVYRNPGPLQFDGPGADAKPVTLCVEDQDYMGRIKKLQEYLDKVRSIVKPGCSPDVLKAALCAMTSVTDILSVMSSPSSGTTPF

SEQ ID NO: 6821 - protein, 616 aa, Orobanche aegyptiaca
MDSDYGIPRELSDLQKLRSLYKPELPPCLQGTAVRVEFGDVAIAADPTGAHTISRSFPHTYGQPIAHFLRATAKVPDAQIITELPAVRVGVVFCGRQSPGGHNVIWGLFDALKVHNPRSTLLGFLGGSDGLFAQKTLEITDDILATYKNQGGYDLLGRTKDQIRTTEQVNAALNTCTALKLDALVIIGGVTSNTDASQLAETFADRKCPTKVVGIPVTLNGDLKNQFVETNVGFDTICKVNSQLISNVCTDALSAEKYYYFIRLMGRKASHVALECTLQSHPNMVILAEEVAASKLTLFDITKQICDAVQARGEQDKHHGVILLPEGLIESIPEVYALLQEIHLLLREGVFADNISAQLSPWASALFDFLPPFIRKQLLLHPESDDSAQLSQIETEKLLAHLVEAEMNKRLKEGTYKGKKFNAICHFFGYQARGSLPSKFDCDYAYVLGHIGYHVIAAGLNGYMATVTNLKNPVNKWKCGAAPITAMLNVKRYGRGHGALTLGKPALHPASVDLKGKSYELLRQNATKFLMDDVYRNPGPLQFDGPGADAKPVTLCVEDQDYMGRIKKLQEYLDKVRSIVKPGCSQDVLKAALSAMSSVTDVLSIMSAPSSGSTPF

SEQ ID NO: 6822 - protein, 616 aa, Triphysaria pusilla
MDSDYGIARELSDLQKLRSLYQPELPPCLQGTAVRVEFGDVATAADSSGAHTISRSFPHTYGQPIAHFLRATAKVPEAQIITELPAVKVGVVFCGRQSPGGHNVIWGLFDALKVHNPKSTLLGFLGGSDGLFAQKTLEITDEILATYKNQGGYDLLGRTKDQIKTTEQVNAALKTCTTLKLDALVIIGGVTSNTDAAQLAETFAERKCPTKVVGVPVTLNGDLKNQFVETNVGFDTICKVNSQLISNVCTDALSAEKYYYFIRLMGRKASHVALECTLQSHPNMVILAEEVAASKLTLFDITKQICDAVQSRGEQDKHHGVILLPEGLIESIPEVYALLQEIFGLLREGVSADNISAQLSPWASALFEFLPPFIRKQLLLHPESDDSAQLSQIETEKLLAHLVEAEMNKRLKEGTYKGKKFNAICHFFGYQARGSLPSKFDCDYAYVLGHIGYHIVAAGLNGYIATVTNLKNPVNKWKCGAAPISAMLTVKRYGRGHGASTLGKPALHPGTVDLKGKSYELLRQNATKFLMDDVYRNPGPLQFDGPGADAKPVTLCVEDQDYMGRIKKLQEYLDKVRSIVKPGCSQDVLKAALSSMSSVTEILSIMSAPSSGGTPF

SEQ ID NO: 6823 - protein, 619 aa, Aristolochia fimbriata
MDSDYGVPRELSALQKHRTLYHPELPPCLQGTTVRVEFGDATTAADLAGAHTISRAFPHTYSQPLAHFLRANAVVPDAQIITEHPSIRVGVVFCGRQSPGGHNVIWGLYDAIKLHNPKSTLLGFSGGTDGLFAQKTLEITEEVLASYKNQGGYDMLGRTKDQIRTTEQVNAALASCQALKLDGLVIIGGVTSNTDAAQLAETFAESKCPTKVVGVPVTLNGDLKNQFVETNVGFDTICKVNSQLISNVCTDALSAEKYYYFIRLMGRKASHVALECTLQSHPNMVILGEEVAASKLTLFDLTKQICDAVQARAEQDKYHGVILLPEGLIESIPEVYALLQEIHGLHREGISADNISAHLSPWASALIEFLPLFIRRQLLLHPESDDSAQLSQIETEKLLAQLVETEMNKRMKEGTYKGKKFNAICHFFGYQARGSLPSKFDCDYAYVLGHISYHILAAGLNGYMATVTNLKSPVNKWRCGAAPITAMMTVKRWSRGPKATSIGKPAVHPAAVDLKGKAYELLRQNATKLLMDDVYKNPGPLQFDGPGADIKAVTLAVEDQDYMGRIKKLQEYLDKVRSMVKPGCSQDVLKAALSAMASVTDVLSVMSAPSFSNQYPSNL

SEQ ID NO: 6824 - protein, 616 aa, Mimulus guttatus
MDSDYGIARELSDLQKLRSHYQPELPPCLQGTTVRVHFGDATAAADPTGAHTISRSFPLTYGQPLAHFLRSTAKVPDAQIITEHAAVRVGVVFCGRQSPGGHNVIWGLHEALKVHNPKSVLLGFLGGSDGLFAQKTLEVTDEVLATYKNQGGYDLLGRTKDQIRTIEQVNAALNACTALKLDALVIIGGVTSNTDAAQLAETFAERKCPTKVVGIPVTLNGDLRNQFVETNVGFDTICKVNSQLISNVCTDALSAEKYYYFIRLMGRKASHVALECTLQSHPNMVILAEEVAASKLTIFDITNQICDAVQARAEQDKYHGVILLPEGLIESFPEVFALLQEIHALLRQGVSADNISAQLSPWASALFEFLPPFIRKQLLLHPESDDSAQLSQIETEKLLAHLVEAEMNKRTKEGTYKGKKFNAICHFFGYQARGSLPSKFDCDYAYVLGHIGYHIIAAGLNGYMATLTNLKNPVNKWRCAAAPITAMMTVKRYGRGHGASILGKPALHPATVDLKGKSYELLRQNSTKFLMDDVYRNPGPLQYDGPGADAKAVTLCVEDQDYMGRIKLLQEHLDKVRSIVKPGCSQDVLKAALSAMASVTEILSVMSAASGGSTPF

SEQ ID NO: 6825 - protein, 557 aa, Plantago ovata
MDSDYGIARELSDLQKLRSLYQPQLPPCLQGKTVRVEYGDATTASDPPGSHAISRSFPHTFGQPIAHFLRATAIVAGAQVISELPATRVGVVFCGRQSPGGHNVIWGLYDALKVHNPKSTLLGFLGGSEGLFAQKTLEITDDILATYKNQGGYDLLGRTKDQIRTTEQVNAALDACLALKLDALVIIGGVTSNTDAAQLAETFAERKCPTKVVGIPVTLNGDLKNQFVETNVGFDTICKVNSQLISNVCTDALSAEKYYYFIRLMGRKASHVALECTLQSHPNMVILGEEVAASKLTLFDITKQICDAVQARSEKDKHHGVILLPEGLIESIPEVYALLQEIHGLLREGVHADQISAKLSPWSSALFEFLPLFIKKQLLLHPESDDSAQLSQIETEKLLAHLVEEEMNKRLKEGTYKGKKFNAICHFFGYQARGSLPSKFDCDYAYVLGHIGYHVIAAGLNGYMATVTNLKNPVNKWKCGAAPITAMMTVKQYGRGHGALVIGKPALHPATVDLKGKAYELLRQNATKFLIEDIYRNPGPLQYDGPGADSEASNSVC

SEQ ID NO: 6826 - protein, 619 aa, Brassica napus
MDSDFGIPRELSPLQQLRSQYHPELPPCLQGTTVRVEFGDGTTVAEASDSHIVARAFPHTLGQPLAHFLREAAKVSDAHIITQLPSIRVGIVFCGRQAPGGHNVIWGLYEALKVHNANSTLLGFLGGSEGLFAQKTLEITDDILQTYKNQGGYDLLGRTKDQIRTTEQVNAALKACTDLKLDGLVIIGGVTSNTDAAHLAEFFAEAKCSTKVVGVPVTTNGDLKNQFVEANVGFDTICKVNSQLISNACTDALSAEKYYYFIRLMGRKHSHVALECTLQSHPNMVILGEEVAASKLTIFDISKQICDAVQARAGQDKNHGVILIPEGIIESIPEVYALLKEIHGLLREGVAADKISTQLSPWSSALFEFLPPFIKKQLLLHPESDDSAQLSQIETEKLLAYLVETEMNKRLKEGTYKGKKFNAICHFFGYQARGSLPSKFDCDYAYVLGHICYHILAAGLNGYMATVSNLKSPVNKWKCGAAPITAMMTVKNWSQNASSTSTSIGRPAIHPAMVDLKGKAYELLRQNADKFLMEDLYRNPGPLQYDGPGADAKAVSLCVEDQDYMGRIKKLQEYLDQVRTIVKPGCSQDVLKAALSVMASVTDVLTTISSSSNGGQQFA

SEQ ID NO: 6827 - protein, 619 aa, Brassica napus
MDSDFGIPRELSPLQQLRSQYQPELPPCLQGTTVRVEFGDGTTVAEASDSHIIARAFTHTLGQPLAHFLREAAKVSDAHIITQLPSIRVGIVFCGRQAPGGHNVIWGLYEALKVHNAKSTLLGFLGGSEGLFAQKTLEITDDILQTYKNQGGYDLLGRTKDQIRTTEQVNAALKACTDLKLDGLVIIGGVTSNTDAAHLAEFFAEAKCSTKVVGVPVTTNGDLKNQFVEANVGFDTICKVNSQLISNACTDALSAEKYYYFIRLMGRKHSHVALECTLQSHPNMVILGEEVAASKLTIFDISKQICDAVQARAGQDKNHGVILIPEGIIESIPEVYALLKEIHGLLREGVAADKISTQLSPWSSALFEFLPPFIKKQLLLHPESDDSAQLSQIETEKLLAYLVETEMNKRLKEGTYKGKKFNAICHFFGYQARGSLPSKFDCDYAYVLGHICYHILAAGLNGYMATVSNLKSPVNKWKCGAAPITAMMTVKNWSQNASSTSTSIGRPAIHPAMVDLTGKAYELLRQNADKFLMEDLYRNPGPLQYDGPGADAKAVSLCVEDQDYMGRIKKLQEYLDQVRTIVKPGCSQDVLKAALSVMASVTDVLTTISSSSNGGQQFA

SEQ ID NO: 6828 - protein, 614 aa, Lactuca sativa
MDSDYGVPRELSDLQKNRSLYKPELPPCLQGTTVRVEFGDATAAADPSGAHAIARSFPHTYGQPLAHFLRATAKGSNAQIINEHPAVKVGLVFCGRQSPGGHNVVWGLHEALKSHNPKSTLLGFLGGSEGLFAQKTLEITDDILATYKNQGGYDLLGRTKDQIRTTEQVNSAMAACKALNLDGLVIVGGVTSNTDAAQLAETFAEAKCSTKVVGVPVTLNGDLKNQFVEANVGFDTICKVNSQLISNVCTDALSAEKYYYFIRLMGRKASHVAVECTLQSHPNMVILAEEVAASKLTIFDITKQICDAVQARAEQGKNHGVILLPEGLIESIPEVYALLQEIHSLLRQGVSADKISTQLSPWASALFEFLPPFIRKQILLHPESDDSAQLSQIETEKLLAELVEAEINKRLKEGTYKGKKFNAICHFFGYQARGSLPSKFDCDYAYVLGHSCYHILASGLNGYMATVTNLKNPSNKWRCGAAPITAMMTVKHYGRGSGSGAITLGKPVVHPATVDLRGRVYELLRQNATRFLMDDVYRNPGPLQFDGPGADSKAVSLCVEDLDYMGRIKELNEYLDKVRTIVKPGCSQDVLKAALSAMSSVTDILSVMTSQRLE

SEQ ID NO: 6829 - protein, 614 aa, Cichorium intybus
MESDYGVPRELSDLQKNRSLYKPELPPCLQGTTVRVEFGDATAAADPSGAHAIARSFPHTYGQPLAHFLRATAKVSNAQTINEHPAVKVGLVFCGRQSPGGHNVVWGLHEALKSHNPKSTLLGFLGGSEGLFAQKTLEITDDVLATYKNQGGYDLLGRTKDQIRTTEQVNSAMAACKALKLDGLVIVGGVTSNTDAAQLAETFAEAKCSTKVVGVPVTLNGDLKNQFVEANVGFDTICKVNSQLISNVCTDALSAEKYYYFIRLMGRKASHVAVECTLQSHPNMVILAEEVAASKLTIFDITKQICDAVQARAEQDKNHGVILLPEGLIESIPEVYALLQEIHSLLRQGVSADKISTQLSPWASALFEFLPPYFRKQLLLHPESDDSAQLSQIETEKLLAELVEAEINKRLKEGTYKGKKFNAICHFFGYQARGSLPSKFDCDYAYVLGHSCYHILAAGLNGYMATVTNLKNPSNKWRCGAAPITAMMTVKHYGRGSGSGAITLGKPVVHPATVDLRGRVYELLRQNATRFLMDDVYRNPGPLQFDGPGADSKAVSLCVEDLDYMGRIKELNEYLEKVRTIVKPGCSQDVLKAALSAMSSVTDILSVMTSQRLE

SEQ ID NO: 6830 - protein, 614 aa, Artemisia annua
MDSDYGVPRELSDLQKDRSLYQPELPPCLQGTTVRVEFGDATAAADPSGANAIARSFPHTYGQPLAHFFREKSKTPNAQTISEHPAVKVGLVFCGRQSPGGHNVVWGLHEALKIHNPKSTLLGFLGGSEGLFAQKTLEITDDVLATYKNQGGYDLLGRTQDQIRTTEQVNSAMAACKALNLDGLVIVGGVTSNTDAAQLAETFAEAKCATKVVGVPVTLNGDLKNQFVEANVGFDTICKVNSQLISNVCTDALSAEKYYYFIRLMGRKASHVAVECTLQSHPNMVILAEEVAASKLTLFDITKQICDAVQARAEQDKNHGVIILPEGLIESIPEVFALLQEIHSLLREGVSADNISTKLSPWASALFEFMPPFIRKQLLLHPESDDSAQLSQIETEKLLAELVEAEINKRLKEGTYKGKKFNAICHFFGYQARGSLPSKFDCDYAYVLGHCCYHILAAGLNGYMATITNLKSPSNKWRCGAAPITAMMTVKHYGRGSGAGATTIGKPVVHPAAVDLRGKVYELLRQNATRFLMDDIYRNPGPLQFEGPGADSKAVSLCVEDLDYMGRIKELNDYLDKVRTIVKPGCSQDVLKAALSAMSSVTDILSVMTSQRLE

SEQ ID NO: 6831 - protein, 617 aa, Fagopyrum esculentum
MDSDFGIARELSDLQKQRSFYQPELPPCLQGTTVRVEFGDATTVSDPTDASAISRYYPRTYGQRLVHFLRATAKVADAKIITEHPPIRVGLVFSGRQSPGGHNVIWGLHEALKIHNSNNVLIGFLGGTEGLFAQKALQITDDVLSTYKNQGGYDLLGRTKDQIRTTEQVNAALAACNALKLDGLVVIGGVTSNTDAAQLAEFFAEANCATKVVGVPVTLNGDLKNQYVETDVGFDTICKVNSQLISNMCTDALSAEKYYYFIRLMGRKASHVSLECALQSHPNMVILGEEVAASKLTLFDLTKQLCDAIQARAEQDKYHGVILLPEGLIENIPEVYALLQEIHGLLRQGVSADKISSQLSPWASALFEFLPPFIKKQLLLHPESDNSAQLSQIETEKLLAHLVEEEINKRVKAGTYKGKKFNAICHFFGYQARGSLPSKFDCDYAYVLGHICYHVLAAGLNGYMATVTNLKNPSNKWKCGAAPFTTMMTVKRHSRGPGASFVGHPAIHTATVDLKGKAYELLRQNASRFLMEDIYRNPGPIQFEGPGSDAKSVSLCVEDQDYMGRIKKLQEYLDQVKTIVKPGCSQDILKAALSAMSSVTDILSVMAGASNNSQGRF

SEQ ID NO: 6832 - protein, 613 aa, Aquilegia formosa
MDSDFGAPRELSDLQKHRTLYEPEIPPCLQGTTVRVEFGDATSTADQSISHSFPHTYGQPLAHFLRATAQIPDAQVINEHPAVRVGAVFCGRQSPGGHNVVWGIHNALKLHNSNNVLLGFLGGSEGLFAQKTLEITDDVLASYKNQGGYDLLGRTKDQIKTTEQVNAALATCKALKLDGLVIIGGVTSNTDAAQLAETFAEAKCPTKVVGVPVTLNGDLRNQFVETNVGFDTICKVNSQLISNVCTDALSAEKYYYFIRLMGRTASHVALECTLQSHPNMVVLGEEVASSKLTLFDLTKQICDAVQARAEQDKNHGVILLPEGLVESIPEVYALLQEIHELHRQGVSIDNMSSNLSPWASALFEFLPPFIKKQLLLHPESDDSAQLSQIETEKLLADLVETEMTKRLKEGTYKGKKFNAICHFFGYQARGSLPSKFDCDYAYVLGHICYHILAAGLNGYMATVTNLKNPVNKWRCGAAPITAMMTVKRYSRGPGTSSIGKPAVHPAQVDLKGKAYELLRQNATKFLMDDVYRNPGPLQFDGAGADTKTVSLCVEDQDYMGRIKKLQEYLDKVRNIVKPGCSQDVLKAALSAMTSVTDILSIMSAPSSTGSTPV

SEQ ID NO: 6833 - protein, 614 aa, Helianthus annuus
MDSDYGVPRELSDLQKNRSLYTPELPPCLQGTTVRVEFGDATAAADPAGAHAIARSFPHTYGQPLVHFFREKSKPVNAQTISEHLAVRVGLVFCGRQSPGGHNVVWGLHEALKIHNPKSVLLGFLGGSDGLFAQKTLEITDDVLATYKNQGGYDLLGRTKDQIRTIEQVNSAMEACKALKLDALVIVGGVTSNTDAAQLAETFAEAKCSTKVVGVPVTLNGDLKNQFVEANVGFDTICKVNSQLISNVCTDALSAEKYYYFIRLMGRKASHVAVECTLQSHPNMVILAEEVAASKLTIFDITKQICDAVQARAEQDKNHGVILLPEGLIESIPEVYALLQEIHSLLRQGVSADNISTQLSPWASALFEFMPPFIRKQLLLHPESDDSAQLSQIETEKLLAELVEAEINKRLKEGTYKGKKFNAICHFFGYQARGSLPSKFDCDYAYVLGHICYHILAAGLNGYMATVTNLKSPSNKWRCGAAPITAMMTVKHYGRGSGSGATTLGKPFVHPAAVDLRGKVYELLRQNATRFLLDDVYRNPGPLQFDGPGADSKAVSLCVEDLDYMGRIKELNDYLEKVRTIVKPGCSQDVLKAALSAMSSVTDILSVMTSQRLD

SEQ ID NO: 6834 - protein, 614 aa, Arnica chamissonis
MESDYGVPRELSDLQKNRSLYTPELPPCLQGTTVRVEFGDATAAADSSDAHAIARSFPLTYGQPLVHFFREKSKAVNAQTIVEHPAVRVGLVFCGRQSPGGHNVVWGLHEALKIHNPKSILLGFLGGSDGLFAQKTLQITDDVLATYKNQGGYDLLGRTKDQIRTTEQVNSAMAACKALNLDALVIVGGVTSNTDAAQLAETFAEAKCSTKVVGVPVTLNGDLKNQFVEANVGFDTICKVNSQLISNVCTDALSAEKYYYFIRLMGRKASHVAVECTLQSHPNMVILAEEVAASKLTIFDITNKICDAVQARAEQDKNHGVILLPEGLIESIPEVYALLQEIHSLLRQGVSADKISTQLSPWASALFEFMPPFIRKQLLLHPESDDSAQLSQIETEKLLAELVEAEINKRLKEGTYKGKKFNAICHFFGYQARGSLPSKFDCDYAYVLGHICYHILAAGLNGYMATVTNLKRPSNKWRCGAAPITAMMTVKHYGRGSGSGAATLGKPVVHPTTVDLRGKVYDLLKQNATRFLLDDVYRNPGPLQFDGPGADSKAVSLCVEDLDYMGRIKELNDYLDKVRTIVKPGCSQDVLKAALSAMSSVTDILSVMTSQRAE

SEQ ID NO: 6835 - protein, 473 aa, Fragaria vesca
MDSDYGIPRELSAVQKLRSQYQPDLPPCLQGTTVRVEFGDTTTAADPTDANTISRYFPNTYGQPLAHFLRATAKVAGAQVISEHPAMRVGIVFCGRQSPGGHNVIWGLLKALKTHNPNSTLLGFLGGSEGLFAQKTLEITDDVLATYKNQGGYDLLGRTKDQIRTKEQVNATLTACNALKLAGLVIIGGVTSNTDAAQLAETFAEAKCQTKVVGVPVTMNGDLKNQFVEANVGFDTVCKVNSQLISNMCTDALSAEKYYYFIRLMGRKASHVALECTLQSHPNLVILGEEVAASKLTLFDIATRICDAVQDRAAQDKNHGVILLPEGLIESIPEVYALLKEIHGLYRQGVSADKILSQLSPWASALFEFLPHFIKKQLLLLPESDDSAQLSQIETEKLLAHLVEVEMNKRQKEGTYKGKKFNAICHFFGYQARGSLPSKFDCDYAYVLGHICYHMLAAGLNGYMATVTNLKIL

SEQ ID NO: 6836 - protein, 616 aa, Hordeum vulgare
MDSDYGVPRELSEVQQKRTLYQPELPPCLQGTTVRVEYGDVAIAADPAGAHVISHAFPHTYGQPLAHFLRKAANVPDAKVISEHPAVRVGIVFCGRQSPGGHNVIWGLHEAIKAHNLNSKLIGFLGGTDGLLAQKTLEITNEVLSSYKNQGGYDMLGRTKDQIRTTEQVNGAMATCQALKLDALVIIGGVTSNTDAAQLAETFAEAKCATKVVGVPVTLNGDLKNQFVETTVGFDTICKVNSQLISNMCTDALSAEKYYYFIRMMGRKASHVALECALQSHPNMVILGEEVAASKLTIFDITKQICDAVQARAEKDKNHGVILIPEGLVESIPELYALLQEINGLHGKGVSVENISSQLSPWASALFEFLPQFIRQQLLLRPESDDSAQLSQIETEKLLAQLVETEMNKRLKEGTYKGKKFNAICHFFGYQARGAMPSKFDCDYAYVLGHVCYHILAAGLNGYMATVTNLKSPLNKWRCGAAPISSMMTVKRWSRGPATTQIGKPAVHMASVDLRGKAYEMLRQNSSSCLLEDIYRNPGPLQFEGPGADAKPISLCVEDQDYMGRIKKLQEYLEKVKSIVKPGCSQDVLKAALSAMSSVTETLAIMTSSSTGQPPL

SEQ ID NO: 6837 - protein, 616 aa, Triticum aestivum
MDSDYGVPRELSEVQQNRTLYQPELPPCLQGTTVRVEYGDVAIAADPAGAHVISHAYPHTYGQPLAHFLRKAANVPDAKVISEHPAVRVGIVFCGRQSPGGHNVIWGLHEAIKAHNVNSKLIGFLGGTDGLLAQKTLEITNEVLSSYKNQGGYDMLGRTKDQIRTTEQVNGAMATCQALKLDALVIIGGVTSNTDAAQLAETFAEAKCATKVVGVPVTLNGDLKNQFVETTVGFDTICKVNSQLISNMCTDALSAEKYYYFIRMMGRKASHVALECALQSHPNMVILGEEVAASKLTIFDITKQICDAVQARAEKDKNHGVILIPEGLVESIPELYALLQEINGLHGKGVSVENISSQLSPWASALFEFLPQFIRQQLLLRPESDDSAQLSQIETEKLLAQLVETEMNKRLKEGTYKGKKFNAICHFFGYQARGAMPSKFDCDYAYVLGHVCYHILAAGLNGYMATVTNLKSPLNKWRCGAAPISSMMTVKRWSRGPATTQIGKPAVHMASVDLRGKAYEMLRQNSSSCLLEDIYRNPGPLQFEGPGADAKPISLCVEDQDYMGRIKKLQEYLEKVKSIVKPGCSQDVLKAALSAMSSVTETLAIMTSSSTGQPPL

SEQ ID NO: 6838 - protein, 616 aa, Triticum aestivum
MDSDYGVPRELSEVQQKRTLYQPELPPCLQGTTVRVEYGDVAIAADPAGAHVISHAYPHTYGQPLAHFLRKAANVPDAKVISEHPAVRVGIVFCGRQSPGGHNVIWGLHEAIKAHNVNSKLIGFLGGTDGLLAQKTLEITNEVLSSYKNQGGYDMLGRTKDQIRTTEQVNGAMATCQALKLDALVIIGGVTSNTDAAQLAETFAEAKCATKVVGVPVTLNGDLKNQFVETTVGFDTICKVNSQLISNMCTDALSAEKYYYFIRMMGRKASHVALECALQSHPNMVILGEEVAASKLTIFDITKQICDAVQARAEKDKNHGVILIPEGLVESIPELYALLQEINGLHGKGVSVENISSQLSPWASALFEFLPQFIRQQLLLRPESDDSAQLSQIETEKLLAQLVETEMNKRLKEGTYKGKKFNAICHFFGYQARGAMPSKFDCDYAYVLGHVCYHILAAGLNGYMATVTNLKSPLNKWRCGAAPISSMMTVKRWSRGPATTQIGKPAVHMASVDLRGKAYEMLRQNSSSCLLEDIYRNPGPLQFEGPGADAKPISLCVEDQDYMGRIKKLQEYLEKVKSIVKPGCSQDVLKAALSAMSSVTETLAIMTSSSTGQPPL

SEQ ID NO: 6839 - protein, 313 aa, Gossypium hirsutum
MVSDASKKKAAQKKAAAAAKRGGKAAASAASSKATASATAENGVDNVSDKVSMLQISDRTCTGVLCSHPLSRDIRIESLSVTFHGHDLIVDSTLELNYGRRYGLLGLNGCGKSTLLTAIGLRELPIPEHMDIYHLTREIEASDMSALQAVISCDEERLKLEKEAEILAAQDDGGGETLERIYERLDALDASTAEKRAAEILFGLGFNKMMQAKKTRDFSGGWRMRIALARALFMNPTILLLDEPTNHLDLEACVWLEENLKKFDRILVVISHSQDFLNGVCTNIIHMQNKNLSCTPAIMISTFKLVLNWKRTR

SEQ ID NO: 6840 - protein, 292 aa, Gossypium hirsutum
MVSDASKKKAAQKKAAAAAKRGGKAAAAAASSKAAAAATAENGVDKVSDKVSMLQISDRTCTGVLCSHPLSRDIRIESLSVTFHGHDLIVDSTLELNYGRRYGLLGLNGCGKSTLLTAIGLRELPIPEHMDIYHLTREIEASDMSALQAVISCDEERLKLEKEAEILAAQDDGGGEALERIYERLDALDASTAEKRAAEILFGLGFNKMMQAKKTRDFSGGWRMRIALARALFMNPTILLLDEPTNHLDLEACVWLEENLKKFDRILVVISHSPGFPERSLYEHYPHAKQKT

SEQ ID NO: 6841 - protein, 601 aa, Theobroma cacao
MVSDASKKKAAQKKAAAAAKRGGKAAAAAASSKAAAAAAASDTGVDKVSDGVSALQISDRTCTGVLCSHPLSRDIRIESLSVTFHGHDLIVDSILELNYGRRYGLLGLNGCGKSTLLTAIGLRELPIPEHMDIYHLTREIEASDMSALEAVISCDEERLKLEKEAETLAGQDDGGGEQLERIYERLEAMDASTAEKRAAEILFGLGFNKKMQAKKTRDFSGGWRMRIALARALFMNPTILLLDEPTNHLDLEACVWLEENLKKFDRILVVVSHSQDFLNGVCTNIIHMQNKKLKLYTGNYDQYVQTRAELEENQMKQYKWEQEQIASMKEYIARFGHGSAKLARQAQSKEKTLAKMERGGLTEKVVRDKVLVFRFVDVGKLPPPVLQFVEVTFGYTPDNLIYKDLDFGVDLDSRIALVGPNGAGKSTLLKLMTGDLGPIDGMVRRHNHLRIAQFHQHLAEKLDLEMSALQYMIKEYPGNEEERMRAAIGKFGLSGKAQVMPMRNLSDGQRSRVIFAWLAFRQPHLLLLDEPTNHLDIETIDSLAEALNEWDGGLVLVSHDFRLINQVAEEIWVCENQTVTRWEGDIMDFKEHLKSKAGLSD

SEQ ID NO: 6842 - protein, 600 aa, Ricinus communis
MVSDASKKKAAQKKAAAAAKRGGKASASSKAAAAATAAADNGSVDKLSNGIGAMQISDRTCTGVLCSHPLSRDIRIESLSVTFHGHDLIVDSVLELNYGRRYGLLGLNGCGKSTLLTAIGCRELPIPDHMDIYHLTREIEASDMSSLQAVISCDEERLKLEKEVEILAAQDDGGGESLERIYERLEAIDASTAEKRAAEILFGLGFSKQMQAKKTRDFSGGWRMRIALARALFMNPTILLLDEPTNHLDLEACVWLEETLKKFERILVVVSHSQDFLNGVCTNIIHMQNKTLKIYTGNYDQYVQTRSELEENQMKQYKWEQEQIASMKEYIARFGHGSAKLARQAQSKEKTLAKMERGGLTEKVVRDKVLVFRFVDVGKLPPPVLQFVEVAFGYTPENILYRNLDFGVDLDSRIALVGPNGAGKSTLLKLMTGDLVPVDGMVRRHNHLRIAQFHQHLAEKLDLDMSALHFMIREYPGNEEEKMRAAIGKFGLTGKAQVMPMKNLSDGQRSRVIFAWLAYRQPHMLLLDEPTNHLDIETIDSLAEALNEWDGGLVLVSHDFRLINQVAEEIWVCENQAVTRWEGDIMDFKEHLKRKAGLSD

SEQ ID NO: 6843 - protein, 601 aa, Cucumis melo
MVSDASKKKAAQKKAAAAAKRGGKAAAAAASSKAAAAAAESQNGVDKLANGVDALQLSDRTCTGVLCSHPLSRDIRIESLSVTFHGHDLIVDSELELNYGRRYGLLGLNGCGKSTLLAAIGCRELPIPEHMDIYHLSREIEASDMSSLEAVISCDEERLKLEQEAESLAAQDDGGGEQLDRIYERLEALDAATAEKRAAEILYGLGFNKQMQAKKTRDFSGGWRMRIALARALFMNPTVLLLDEPTNHLDLEACVWLEENLKKFDRILVVVSHSQDFLNGVCTNIIHMQNRKLKIYTGNYDQYVQTRSELEENQMKMYKWEQDQIASMKEYIARFGHGSAKLARQAQSKEKTLAKMERGGLTEKVVRDKVLVFRFVDVGKLPPPVLQFVEVTFGYTPDNLIYKNLDFGVDLDSRIALVGPNGAGKSTLLKLMTGDLVPLDGMVRRHNHLRIAQFHQHLAEKLDLEVSALQFMIREYPGNEEEKMRGAIGKFGLSGKAQVMPMKNLSDGQRSRVIFAWLAWRQPHLLLLDEPTNHLDIETIDSLAEALNEWDGGMVLVSHDFRLINQVAEEIWVCENQAVTKWEGDIMDFKAHLKMKAGLAD

SEQ ID NO: 6844 - protein, 601 aa, Cucumis sativus
MVSDASKKKAAQKKAAAAAKRGGKAAAAAASSKAAAAAAESQNGVDKLANGVDALQLSDRTCTGVLCSHPLSRDIRIESLSVTFHGHDLIVDSELELNYGRRYGLLGLNGCGKSTLLAAIGCRELPIPEHMDIYHLSREIEASDMSSLEAVISCDEERLKLEQEAESLAAQDDGGGEQLDRIYERLEALDAATAEKRAAEILYGLGFNKQMQAKKTRDFSGGWRMRIALARALFMNPTVLLLDEPTNHLDLEACVWLEENLKKFDRILVVVSHSQDFLNGVCTNIIHMQNRKLKIYTGNYDQYVQTRSELEENQMKMYKWEQDQIASMKEYIARFGHGSAKLARQAQSKEKTLAKMERGGLTEKVVRDKVLVFRFVDVGKLPPPVLQFVEVTFGYTPDNLIYRNLDFGVDLDSRVALVGPNGAGKSTLLKLMTGDLVPLDGMVRRHNHLRIAQFHQHLAEKLDLEVSALQFMIREYPGNEEEKMRGAIGKFGLSGKAQVMPMKNLSDGQRSRVIFAWLAWRQPHLLLLDEPTNHLDIETIDSLAEALNEWDGGLVLVSHDFRLINQVAEEIWVCENQAVTKWEGDIMDFKAHLKMKAGLAD

SEQ ID NO: 6845 - protein, 593 aa, Glycine max
MVSDASKKKAAQKKAAAAAKRGGKAAAAAASSKTTSSEKLADGIRDIQISDRTCTGVLCSHPLSRDIRIESMSVTFHGHDLIVDSELELNYGRRYGLLGLNGCGKSTLLTAIGCRELPIPDHMDIYHLTREIEASDMSALEAVISCDEERLSLEKEAEALAAQDDGGGEALERIYERLEAIDASTAEKRAAENLFGLGFNKQMQAKKTRDFSGGWRMRIALARALFMNPTILLLDEPTNHLDLEACVWLEENLKKFDRILVVVSHSQDFLNGVCTNIIHMQNKKLKLYTGNYDQYVQTRSELEENQMKQYKWEQEQIASMKEYIARFGHGSAKLARQAQSKEKTLAKMERGGLAEKVVRDKVLVFRFVDVGKLPPPVLQFVEVTFGYTPDNLIYKKLDFGVDLDSRIALVGPNGAGKSTLLKLMTGDLEPLDGMVRRHNHLRIAQFHQHLAEKLDLEISALQFMIKEYPGNEEERMRAAIGKFGLSGKAQVMPMKNLSDGQRSRVIFAWLAYRQPHLLLLDEPTNHLDIETIDSLAEALNEWDGGMVLVSHDFRLINQVAHEIWVCADQAVTRWEGDIMDFKEHLRSKAGLSD

SEQ ID NO: 6846 - protein, 595 aa, Glycine max
MVSDASKKKAAQKKAAAAAKRGGKAAAASSKTTSSEKAADKLANGIGEIQISDRTCTGVLCSHPLSRDIRIESLSVTFHGHDLIVDSELELNYGRRYGLLGLNGCGKSTLLTAIGCRELPIPDHMDIYHLTREIEASDMSALEAVISCDEERLRLEKEAEALAAQDDGGGEALERIYERLEAIDASTAEKRAAEILFGLGFNKQMQAKKTRDFSGGWRMRIALARALFMNPTILLLDEPTNHLDLEACVWLEENLKKFERILVVVSHSQDFLNGVCTNIIHMQNKKLKLFTGNYDQYVQTRAELEENQMKQYKWEQEQIASMKEYIARFGHGSAKLARQAQSKEKTLAKMERGGLAEKVVRDKVLVFRFVDVGKLPPPVLQFVEVTFGYTPDNLIYKNLDFGVDLDSRIALVGPNGAGKSTLLKLMTGDLEPLDGMVRRHNHLRIAQYHQHLAEKLDLEMSALQYMIKEYPGNEEERMRAAIGKFGLSGKAQVMPMKNLSDGQRSRVIFAWLAYRQPHLLLLDEPTNHLDIETIDSLAEALNEWDGGMVLVSHDFRLINQVAHEIWVCADQAVTRWEGDIMDFKEHLRSKAGLSD

SEQ ID NO: 6847 - protein, 599 aa, Castanea mollissima
MVSDASKKKAAQKKAAAAAKRGGKAAATSSKSAAAAADSQNGAEKLANGVEALLISDRTCTGVLCSHPLSRDIRIESLSVTFHGHDLIVDSELELNYGRRYGLLGLNGCGKSTLLTAIGCRELPIPEHMDIYHLSREIEASDLSSLEAVMECDEERLKLEREAETLAAQDDGGGEALERIYERLEAMDAATAEKRAAEILFGLGFNKQMQAKKTRDFSGGWRMRIALARALFMNPTILLLDEPTNHLDLEACVWLEETLKKFDRILVVVSHSQDFLNGVCTNIIHMQNKALKIYTGNYDQYVQTRSELEENQMKQYKWEQEQIASMKEYIARFGHGSAKLARQAQSKEKTLAKMERGGLTEKVARDKVLVFRFVDVGKLPPPVLQFVEVAFGYTPDNLIYKNLDFGVDLDSRVALVGPNGAGKSTLLKLMTGDVVPTDGMVRRHNHLRIAQFHQHLAEKLDLELSALQYMIREYPGNEEEKMRAAIGKFGLTGKAQVMPMKNLSDGQRSRVIFAWLAYRQPQMLLLDEPTNHLDIETIDSLAEALNEWDGGLVLVSHDFRLINQVAHEIWVCENQAVTRWEGDIMDFKAHLKRRAGLSD

SEQ ID NO: 6848 - protein, 599 aa, Quercus alba
MVSDASKKKAAQKKAAAAAKRGGKAAATSSKSAAAASDSQNGAEKLANGVEALLISDRTCTGVLCSHPLSRDIRIESLSVTFHGHDLIVDSELELNYGRRYGLLGLNGCGKSTLLTAIGRRELPIPDHMDIYHLSREIEASDLSSLEAVMECDEERLKLEREAEALAAQDDGGGEALERIYERLEAMDAATAEKRAAEILFGLGFDKQMQAKKTRDFSGGWRMRIALARALFMNPTILLLDEPTNHLDLEACVWLEETLKKFDRILVVVSHSQDFLNGVCTNIIHMQNKALKIYTGNYDQYVQTRSELEENQMKQYKWEQEQIASMKEYIARFGHGSAKLARQAQSKEKTLAKMERGGLTEKVARDKVLVFRFVDVGKLPPPVLQFVEVAFGYTPDNLIYKNLDFGVDLDSRVALVGPNGAGKSTLLKLMTGDVVPTDGMVRRHNHLRIAQFHQHLAEKLDLEVSALQYMIREYPGNEEEKMRAAIGKFGLTGKAQVMPMKNLSDGQRSRVIFAWLAYRQPQLLLLDEPTNHLDIETIDSLAEALNEWDGGLVLVSHDFRLINQVAHEIWVCENQAVTRWEGDIMDFKAHLKQRAGLSD

SEQ ID NO: 6849 - protein, 602 aa, Populus trichocarpa
MVSEASKKKAAQKKAAAAAKRGGKAAATSSKRAAATAASDSQNEGVDKLSNGAGVLQISDRTCTGVLCSHPLSRDIRIESLSVTFHGHDLIVDSELELNYGRRYGLLGLNGCGKSTLLAAIGCRELPIPDHMDIYHLTREIEASDMSSLEAVISCDEERLKLEKEAEVLAAEDDGGGEALDRIYERLEAMDASTAGKRAAEILYGLGFNKKMQEKKTRDFSGGWRMRIALARALFMNPTILLLDEPTNHLDLEACVWLEETLKKFDRILVVVSHSQDFLNGVCTNIIHMQNKKLKIYTGNFDQYVQTRSELEENQMKQYKWEQDQIASMKEYIARFGHGSAKLARQAQSKEKTLAKMERGGLTEKVARDKILVFRFVNVGKLPPPVLQFVEVTFGYTPDNLIYKSIDFGVDLDSRIALVGPNGAGKSTLLKLMTGDLVPLDGMVRRHNHLRIAQFHQHLAEKLDLEMSALQYMIKEYPGNEEERMRAAIGKFGLTGKAQVMPMKNLSDGQRSRVIFAWLAYRQPHLLLLDEPTNHLDIETIDSLAEALNEWDGGLVLVSHDFRLINQVAEEIWVCENQAVTRWEGDIMDFKKHLKMKAGLSD

SEQ ID NO: 6850 - protein, 595 aa, Glycine max
MVSDASKKKAAQKKAAAAAKRGGKAAAAAVMAATSSKAADKVANGIADIQISDRTCTGVLCSHPLSRDIRIESLSVTFHGHDLIVDSELELNYGRRYGLLGLNGCGKSTLLTAIGCRELPIPDHMDIYHLTREIDASDMSALEAVISCDEERLKLEKEAEALAAQDDGGGESLERIYERLDALDAATAEKRAAEILHGLGFDKQMQAKKTRDFSGGWRMRIALARALFMNPTILLLDEPTNHLDLEACVWLEESLKKFERILVVISHSQDFLNGVCTNIIHMQSKKLKLYTGNYDQYVQTRSELEENQMKQYKWEQEQIASMKEYIARFGHGSAKLARQAQSKEKTLAKMERGGLAEKVVRDKVLVFRFTDVGKLPPPVLQFVEVSFGYTPDNLIYKNIDFGVDLDSRVALVGPNGAGKSTLLKLMTGDLMPSDGMVRRHNHLRIAQYHQHLAEKLDMEMSALQFMIKEYPGNEEEKMRAAIGKFGLSGKAQVMPMKNLSDGQRSRVIFAWLAWRQPQMLLLDEPTNHLDIETIDSLAEALNEWDGGLVLVSHDFRLINQVAHEIWVCANQSVTRWEGDIMEFKAHLKSKAGLSD

SEQ ID NO: 6851 - protein, 594 aa, Glycine max
MVSDASKKKAAQKKAAAAAKRGGKAAAAAVMEASSKAANKVANGIADIQISDRTCTGVLCSHPLSRDIRIESLSVTFHGHDLIVDSELELNYGRRYGLLGLNGCGKSTLLTAIGCRELPIPDHMDIYHLTREIDASDMSALEAVISCDEERLKLEKEAEVLAAQDDGGGESLERIYERLDALDAATAEKRAAEILHGLGFDKQMQAKKTRDFSGGWRMRIALARALFMNPTILLLDEPTNHLDLEACVWLEESLKKFERILVVISHSQDFLNGVCTNIIHMQSKKLKIYTGNYDQYVQTRSELEENQMKQYKWEQEQIASMKEYIARFGHGSAKLARQAQSKEKTLAKMERGGLAEKVVRDKVLVFRFTDVGKLPPPVLQFVEVSFGYTPDNLIYKNIDFGVDLDSRVALVGPNGAGKSTLLKLMTGDLMPSDGMVRRHNHLRIAQYHQHLAEKLDMEMSALQFMIKEYPGNEEEKMRGAIGKFGLSGKAQVMPMKNLSDGQRSRVIFAWLAWRQPQMLLLDEPTNHLDIETIDSLAEALNEWDGGLVLVSHDFRLINQVAHEIWVCANQSVTRWEGDIMEFKAHLKSKAGLSD

SEQ ID NO: 6852 - protein, 598 aa, Tripterygium wilfordii
MVSDASKKKAAQKKAAAAAKRGGKAAASSKAKSASDSQNGGVDKVSDGLAGFQISDRTCTGVLCSHPLSRDIRIESLSVTFHGHDLIVDSELELNYGRRYGLLGLNGCGKSTLLTAIGCRELPIPDHMDIYHLSREIEASDMSSLEAVINCDEERLKLEKEAEVLAAQDDGGGEALERLYERLEAMDASTAEKRAAEILYGLGFNKEMQAKKTRDFSGGWRMRIALARALFMNPTILLLDEPTNHLDLEACVWLEETLKNFDRILVVVSHSQDFLNGVCTNIIHMQSRKLKLYSGNYDQYVQTRSELEENQMKQYKWEQEQISNMKEYIARFGHGSAKLARQAQSKEKTLAKMERGGLTEKVARDQILVFRFVDVGKLPPPVLQFSEVTFGYTPENLIYKNIDFGVDLDSRIALVGPNGAGKSTLLKLMTGDLHPLDGMVRRHNHLRIAQYHQHLAEKLDLELSALLYMMREYPGNEEEKMRAAIGKFGLTGKAQVMPMNNLSDGQKSRVIFAWLAYRQPQLLLLDEPTNHLDIETIDSLAEALNEWDGGMVLVSHDFRLINQVAKEIWVCENQAVTRWEGDIMDFKRHLKSKAGLSD

SEQ ID NO: 6853 - protein, 599 aa, Citrus clementina
MVSDASKKKALQKKAAAAAKRGGKAAAAAASSKAAALQNGSAADKAASEMAAMQISDRTCTGVLCSHPLSRDIRIESLSVTFHGHDLIVDSELELNYGRRYGLLGLNGCGKSTLLTAIGCRELPIPDHMDIYHLSREIEASDMSSLEAVISCDEERLKLEKEAEILGAQEDGGGEQLERVYERLEALDASTAEKRAAEILYGLGFNKTMQAKKTRDFSGGWRMRIALARALFINPTILLLDEPTNHLDLEACVWLEETLKNFDRILVVISHSQDFLNGVCTNIIHMQNKKLKFYTGNFDQYVQTRSELEENQMKQYKWEQEQIASMKEYIARFGHGSAKLARQAQSKEKTLAKMERGGLTEKVVKDKVLVFRFVDVGKLPPPVLQFVEVTFGYTPDNLIYKNLDFGVDLDSRVALVGPNGAGKSTLLKLMTGDLVPLDGMVRRHNHLRIAQFHQHLAEKLDMDMPALQYMIKEYPGNEEERMRAAIGRFGLTGKAQVMPMKNLSDGQRSRVVFAWLAYRQPHMLLLDEPTNHLDIETIDSLAEALNEWDGGLVLVSHDFRLINQVAHEIWVCENQAVTRWEGDIMDFKQHLKAKAGLSD

SEQ ID NO: 6854 - protein, 599 aa, Citrus sinensis
MVSDASKKKALQKKAAAAAKRGGKAAAAAASSKAAALQNGSAADKAASEMAAMQISDRTCTGVLCSHPLSRDIRIESLSVTFHGHDLIVDSELELNYGRRYGLLGLNGCGKSTLLTAIGCRELPIPDHMDIYHLSREIEASDMSSLEAVISCDEERLKLEKEAEILGAQEDGGGEQLERVYERLEALDASTAEKRAAEILYGLGFNKTMQAKKTRDFSGGWRMRIALARALFINPTILLLDEPTNHLDLEACVWLEETLKKFDRILVVISHSQDFLNGVCTNIIHMQNKQLKFYTGNFDQYVQTRSELEENQMKQYKWEQEQIASMKEYIARFGHGSAKLARQAQSKEKTLAKMERGGLTEKVVKDKVLVFRFVDVGKLPPPVLQFVEVTFGYTPDNLIYKNLDFGVDLDSRVALVGPNGAGKSTLLKLMTGDLVPLDGMVRRHNHLRIAQFHQHLAEKLDMDMSALQYMIKEYPGNEEEKMRAAIGRFGLTGKAQVMPMKNLSDGQRSRVVFAWLAYRQPHMLLLDEPTNHLDIETIDSLAEALNEWDGGLVLVSHDFRLINQVAHEIWVCENQAVTRWEGDIMDFKLHLKAKAGLSD

SEQ ID NO: 6855 - protein, 593 aa, Cajanus cajan
MVSDASKMKAAQKKAAAAAKRGGKAAAKKGATSSKAADKVANGIADIQISDRTCTGVLCSHPLSRDIRIESLSVTFHGHDLIVDSELELNYGRRYGLLGLNGCGKSTLLTAIGCRELPIPDHMDIYHLSREIEASDMSALEAVISCDEERLQLEKEAEELAAQDDGGGESLERIYERLDALDAATAEKRAAEILHGLGFDKQMQAKKTRDFSGGWRMRIALARALFMNPTILLLDEPTNHLDLEACVWLEENLKKFERILVVISHSQDFLNGVCTNIIHMQNKKLKLYTGNYDQYVQTRSELEENQMKQYKWEQEQIASMKEYIARFGHGSAKLARQAQSKEKTLAKMERGGLAEKVVRDKVLVFRFTDVGKLPPPVLQFVEVAFGYTPDNLIYKNIDFGVDLDSRVALVGPNGAGKSTLLKLMTGELMPSDGMVRRHNHLRIAQYHQHLAEKLDMEMSALQYMIKEYPGNEEEKMRAAIGKFGLSGKAQVMPMKNLSDGQRSRVIFAWLAFRQPQMLLLDEPTNHLDIETIDSLAEALNEWDGGMVLVSHDFRLINQVAHEIWICADQSVTRWEGDIMEFKQHLKAKAGLSD

SEQ ID NO: 6856 - protein, 596 aa, Prunus persica
MVSDASKKKAAQKKAAAAAKRGGKAAASSKSAATESQNGADKLSNGVGAMHISDRNCTGVLCSHPLSRDIRIESLTVTFHGHDLIVDSELELNYGRRYGLLGLNGCGKSTLLTAIGCRELPIPDHMDIYHLSREIEASDMSSLEAVISCDEERIRLEKEVEELAAQDDGGGEQLERIYERLEALDAATAEKRAAEILYGLGFDKQMQAKKTRDFSGGWRMRIALARALFINPTILLLDEPTNHLDLEACVWLEETLKNFERILVVISHSQDFLNGVCTNIIHMQSKKLKIYTGNYDQYVQTRSELEENQMKQYKWEQEQISNMKEYIARFGHGSAKLARQAQSKEKTLAKMERGGLTEKVARDKVLVFRFVDVGKLPPPVLQFVEVTFGYTPDNLIYKNIDFGVDLDSRIALVGPNGAGKSTLLKLMTGELFPSDGMVRRHNHLRIAQFHQHLAEKLDMELSALAYMIKEYPGNEEEKMRAAIGKFGLSGKAQVMAMKNLSDGQRSRVIFAWLAFRQPQLLLLDEPTNHLDIETIDSLAEALNEWDGGLVLVSHDFRLINQVAQEIWVCENQAVTRWEGDIMDFKRHLKVKAGLGE

SEQ ID NO: 6857 - protein, 599 aa, Aristolochia fimbriata
MVSDASKKKAAQKKAAAAAKRGGKVAAAASSKASSASAADNGAEKLSNGVSSLQISDRTCTGILCSHPLSRDIHIESLSVTFHGHDLIVDSELELNYGRRYGLLGLNGCGKSTLLIALGCRELPIPDHMDIYHLSSEIEASDMTALQAVISCDEERLQLEKEAEALASQDDGGGEALERVYERLEALDAATAEKRAAEILFGLGFNKKMQAKQTRDFSGGWRMRIALARALFMNPTILLLDEPTNHLDLEACVWLEETLKKFDRILVVISHSQDFLNGVCTNIIHMQNKKLKLYTGNYDQYVQTRSELEENQMKQYRWEQEQIASMKEYIARFGHGSAKLARQAQSKEKTLAKMERGGLTEKVARDKILVFRFTDVGKLPPPVLQFVEVTFGYTPDNLIYKNLDFGVDLDSRIALVGPNGAGKSTLLKLMTGDLVPLDGMVRRHNHLRIAQFHQHLTEKLDMELSALQFMIKEYPGNEEERMRAAIGKFGLTGKAQVMPMKNLSDGQRSRVIFAWLAWRQPHMLLLDEPTNHLDIETIDSLAEALNEWDGGLVLVSHDFRLINQVAHEIWVCENQAVSRWEGDIMDFKEHLRSKSGLID

SEQ ID NO: 6858 - protein, 599 aa, Citrus sinensis
MVSDASKKKALQKKAAAAAKRGGKAAAAAASSKAAALQNGSAADKAASEMAAMQISDRTCTGVLCSHPLSRDIRIESLSVTFHGHDLIVDSELELNYGRRYGLLGLNGCGKSTLLTAIGCRELPIPDHMDIHHLTREIEASDMSSLEAVISCDEERLKLEKEAEILGAQEDGGGEQLERVYERLEALDASTAEKRAAEILYGLGFNKTMQAKKTRDFSGGWRMRIALARALFINPTILLLDEPTNHLDLEACVWLEETLKKFDRILVVISHSQDFLNGVCTNIIHMQNKKLKFYTGNFDQYVQTRSELEENQMKQYKWEQEQIASMKEYIARFGHGSAKLARQAQSKEKTLAKMERGGLTEKVVKDKVLVFRFVDVGKLPPPVLQFVEVTFGYTPDNLIYKNLDFGVDLDSRVALVGPNGAGKSTLLKLMTGDLVPLDGMVRRHNHLRIAQFHQHLAEKLDMDMPALQYMIKEYPGNEEERMRAAIGRFGLTGKAQVMPMKNLSDGQRSRVVFAWLAYRQPHMLLLDEPTNHLDIETIDSLAEALNEWDGGLVLVSHDFRLINQVAHEIWVCENQAVTRWEGDIMDFKLHLKAKAGLSD

SEQ ID NO: 6859 - protein, 590 aa, Medicago truncatula
MVSEASKKKAAQKKAAAAAKRGGKVAAVSSKKAVDSVANGIGDIQISDRTCTGVLCSHPLSRDIRIESLSVTFHGHDLIVDSELELNYGRRYGLLGLNGCGKSTLLTAIGCRELPIPDHMDIYHLSREIEASDMSALEAVISCDEERLKLEKEAEILGAQEDGGGEALERVFERLEAMDASTAEKRAAEILFGLGFNKQMQAKKTRDFSGGWRMRIALARALFMNPTILLLDEPTNHLDLEACVWLEENLKKFDRILVVISHSQDFLNGVCTNIIHMQNKKLKFYTGNYDQYVQTRAELEENQMKQYRWEQEQIASMKEYIARFGHGSAKLARQAQSKEKTLAKMERGGLTEKVVRDKILVFRFVDVGKLPPPVLQFVEVTFGYTPDNLIYKNIDFGVDLDSRIALVGPNGAGKSTFLKLMTGDLVPLDGMVRRHNHLRIAQFHQHLTEKLDLELSALQFMIKEYPGNEEEKMRAAIGKFGLSGKAQVMPMRNLSDGQRSRVIFAWLAYRQPHLLLLDEPTNHLDIETIDSLAEALNEWDGGMVLVSHDFRLINQVAHEIWVCADQTVTRWEGDIMDFKLHLKEKAGLSD

SEQ ID NO: 6860 - protein, 599 aa, Populus trichocarpa
MVSDASKKKAAQKKAAAAAKRGGKAAATSSKAAAAADSQNGGVDKLSNGVGALQISDRTCTGVLCSHPLSRDIRIESLSVTFHGHDLIVDSELELNYGRRYGLLGLNGCGKSTLLAAIGCRELPIPEHMDIYHLTREIEASDMSSLEAVISCDEERLELEKEAEALAAQDDGGGEALDRVYERLEAMDVATAEKRAAEILFGLGFNKQMQTKKTRDFSGGWRMRIALARALFMNPTVLLLDEPTNHLDLEACVWLEETLKNFERILVVVSHSQDFLNGVCTNIIHMQSKKLKIYTGNYDQYVQTRSELEENQMKQYKWEQDQISSMKEYIARFGHGSAKLARQAQSKEKTLAKMERGGLTERVARDQVLVFRFVDVGKLPPPVLQFVEVTFGYTPDNLIYKNLDFGVDLDSRVALVGPNGAGKSTLLKLMTGDLVPLDGMVRRHNHLRIAQFHQHLTEKLDLELSALLFMIREYPGNEEEKMRAAIGKFGLTGKAQVMPMSNLSDGQRSRVIFAWLAFRQPQMLLLDEPTNHLDIETIDSLAEALKEWDGGLVLVSHDFRLINQVAQEIWVCENQAVTRWEGDIMEFKAHLKKKAGLLD

SEQ ID NO: 6861 - protein, 595 aa, Vigna unguiculata
MVSDASKKKAAQKKAAAAAKRGGKAAAAAVVAAASSKAADKAANGIADMHISDRTCTGVLCSHPLSRDIRIESLSVTFHGHDLIVDSELELNYGRRYGLLGLNGCGKSTLLTAIGQRELPIPEHMDIYHLTREIEASDMSALEAVISCDEERLKLEKEAEILAAQDDGGGESLERVYERLDALDAATAEKRAAEILYGLGFDKQMQAKKTRDFSGGWRMRIALARALFMNPTILLLDEPTNHLDLEACVWLEESLKKFERILVVISHSQDFLNGVCTNIIHMQSKKLKLYTGNYDQYVQTRSELEENQMKQYKWEQEQIASMKEYIARFGHGSAKLARQAQSKEKTLAKMERGGLAEKVVRDKVLVFRFTDVGKLPPPVLQFVEVSFGYTPDNLIYKNIDFGVDLDSRVALVGPNGAGKSTLLKLMTGDLMPSDGMVRRHNHLRIAQYHQHLAEKLDLDMSALQFMIKEYPGNEEEKMRAAIGKFGLSGKAQVMPMKNLSDGQRSRVIFAWLAWRQPQMLLLDEPTNHLDIETIDSLAEALNEWDGGLVLVSHDFRLINQVAHEIWVCANQSVTRWEGGIMEFKAHLKAKAGLSD

SEQ ID NO: 6862 - protein, 594 aa, Aquilegia formosa
MVSDASKKKAAQKKAAAAAKRGGKVAASLKLQNNENSVDKLSNSVGSLQISDRTCTGVLCSHPLSRDIHIESLSVTFHGHDLIVDSELELNYGRRYGLLGLNGCGKSTLLTAIGCRELPIPEHMDIYHLSREIEASDMSALEAVINCDEERLKLEKEAEALAAEDGGGGEALDRIYERLEAMDAATAEKRAAEILFGLGFNKQMQAKKTRDFSGGWRMRIALARALFMNPTILLLDEPTNHLDLEACVWLEETLKKFERILVVVSHSQDFLNGVCTNIIHMQNKKLKLYTGNYDQYVQTRAELEENQMKQYKWEQEQIASMKEYIARFGHGSAKLARQAQSKEKTLAKMERGGLTEKVARDKILVFRFTDVGKLPPPVLQFVEVTFGYTPENFIYKNLDFGVDLDSRVALVGPNGAGKSTLLKLMTGELVPSDGMVRRHNHLRIAQYHQHLAEKLDLEMSALQFMMKEYPGNEEEKMRAAIGRFGLTGKAQVMPMKNLSDGQRSRVIFAWLAWRQPHMLLLDEPTNHLDIETIDSLAEALNEWDGGMVLVSHDFRLINQVAQEIWVCENQTVTRWEGGIMGFKEHLRQKAGLSD

SEQ ID NO: 6863 - protein, 598 aa, Humulus lupulus
MVSDASKKKAAQKKAAAAAKRGGKAAASSASSKAAAVSQNGADKLANGVGALEISDRTCTGVLCSHPLSRDIRIESLSVTFHGHDLIVDSELELNYGRRYGLLGLNGCGKSTLLNAIGHRELPVPEHMDIYHLSREIEASDMSSLEAVISCDEEKIKLEKEVELLSAQDDGGGEQLERIYERLEAMDAATAEKRAAEILYGLGFDKEMQAKKTRDFSGGWRMRIALARALFINPTILLLDEPTNHLDLEACVWLEETLKNFERILVVISHSQDFLNGVCTNIIHMQSKKLKIYSGNYDQYVQTRSELEENQMKQYKWEQEQIASMKEYIARFGHGSAKLARQAQSKEKTLAKMERGGLTEKVARDKVLVFRFVDVGKLPPPVLQFVEVTFGYTPDNLIYKNIDFGVDLDSRIALVGPNGAGKSTLLKLMTGELFPSDGMVRRHNHLRIAQFHQHLTEKLDMDMSALQYMIKEYPGNEEEKMRGSIGRFGLTGKAQVMAMKNLSDGQRSRVIFAWLAFRQPHLLLLDEPTNHLDIETIDSLAEALNEWDGGLVLVSHDFRLINQVAQEIWVCENQTVTRWEGGIMDFKAHLKKKAGLSD

SEQ ID NO: 6864 - protein, 600 aa, Platanus occidentalis
MVSDASKKKAAQKKAAAAAKRGGKAAAAASSKSAASDPQNGGVVDKLTNGVASLQISDRNCTGVLCSHPLSRDIHIESLSVTFHGHDLIVDSDLELNYGRRYGLLGLNGCGKSTLLTAIGCRELPIPEHMDIYHLSREIEASDMSALEAVICCDEERLKLEKEVEALAAEEGGGGEALDRIYERLDALDASTAEKRAAEILFGLGFDKNMQAKKTRDFSGGWRMRIALARALFMKPTILLLDEPTNHLDLEACVWLEETLKNFDRILVVISHSQDFLNGVCTNIIHMQNKKLKLYTGNYDQYVQTRSELEENQMKQYKWEQEQISSMKEYIARFGHGSAKLARQAQSKEKTLAKMERGGLTDKVVRDKVLVFRFTDVGKLPPPVLQFVEVTFGYTPENLIYKNIDFGVDLDSRVALVGPNGAGKSTLLKLMTGDLVPLDGMVRRHNHLRIAQFHQHLTEKLDLEMSALLFMLREYPGNEEEKMRAAIGKFGLTGKAQIMPMKNLSDGQRSRVIFAWLAWRQPHMLLLDEPTNHLDIETIDSLAEALNEWDGGLVLVSHDFRLINQVAQEIWVCEKQTVTRWEGGIMDFKQHLKSKAGLSD

SEQ ID NO: 6865 - protein, 573 aa, Gossypium hirsutum
MVSDASKKKAAQKKAAAAAKRGGKAAASAASSKAAAAATAENGVDNVSDKVSMLQISDRTCTGVLCSHPLSRDIRIESLSVTFHGHDLIVDSTLELNYGRRYGLLGLNGCGKSTLLTAIGLRELPIPEHMDIYHLTREIEASDMSALQAVISCDEERLKLEKEAEILAAQDDGGGETLERIYERLDALDASTAEKRAAEILFGLGFNKMMQAKKTRDFSGGWRMRIALARALFMNPTILLLDEPTNHLDLEACVWLEENLKKFDRILVVVSHSQDFLNGVCTNIIHMQNKKLKLYTGNYDQYVQTRSELEENQMKQYKWEQEQIASMKEYIARFGHGSAKLARQAQSKEKTLAKMERGGLTEKVVRDKVLVFRFVDVGKLPPPVLQFVEVTFGYTPENLIYKNLDFGVDLDSRIALVGPNGAGKSTLLKLMTGELTPIDGMVRRHNHLRIAQFHQHLAEKLDMEMSALQYMIREYPGNEEEKMRGAIGKFGLSGKAQVMPMKNLSDGQRSRVIFAWLAFRQPHLLLLDEPTNHLDIETIDSLAESIERVGRWVGTGESRFPADKPGSRGDMGV

SEQ ID NO: 6866 - protein, 597 aa, Malus domestica
MVSDASKKKAAQKKAAAAAKRGGKAAAAAASSKAAAADNGADKLANGVGSMHISDRNCTGVLCSHPLSRDIRIESLSVTFHGHDLIVDSELELNYGRRYGLLGLNGCGKSTLLTAIGLRELPIPDHMDIYHLSREIEASDMSSLEAVISCDEERIKLEKEVEELAAQDDGGGEQLERIYERLEALDAATAEKRAAEILYGLGFDKQMQAKKTRDFSGGWRMRIALARALFINPTILLLDEPTNHLDLEACVWLEEMLKNFERILVVISHSQDFLNGVCTNIIHMQNKKLKIYTGNYDQYVQTRSELEENQMKQYKWEQEQISNMKEYIARFGHGSAKLARQAQSKEKTLAKMERGGLTEKVARDRVLIFRFVDVGKLPPPVLQFVEVSFGYTPDNLIYKNIDFGVDLDSRIALVGPNGAGKSTLLKLMTGELFPSDGMVRRHNHLRIAQFHQHLAEKLDMELSALAYMIKEYPGNEEEKMRAAIGRFGLSGKAQVMPMKNLSDGQRSRVIFAWLAFRQPQLLLLDEPTNHLDIETIDSLAEALNEWDGGLVLVSHDFRLINQVAQEIWVCENQAVTKWNGDIMDFKQHLKIKAGLAD

SEQ ID NO: 6867 - protein, 593 aa, Euphorbia peplus
MVSDASKKKAAQKKAAAAAKRGGKAASASSKPENGSVDKLSNEVDALQISDRTCTGVLCSHPMSRDIRIESLSVTFHGHDLIVDSILELNYGRRYGLLGLNGCGKSTLLTSIGCRELPIPDHMDIYHLSREIEASDMTALESVISCDEERLKLEKEVEMLAAQDDGGGESLDRIYERLEALDAATAEKRAAEILFGLGFNKKMQAMKTRDFSGGWRMRIALARALFMNPTILLLDEPTNHLDLEACVWLEETLKKFDRILVVVSHSQDFLNGVCTNIIHMQSKTLKIYTGNYDQYCQTRNDLEENQMKQYKWEQEQISSMKEYIARFGHGSAKLARQAQSKEKTLAKMERGGLTEKVARDKVLTFRFVDVGKLPPPVLQFVEVSFGYTPDNLIYKNLDFGVDLDSRIALVGPNGAGKSTLLKLMTGELGPSEGMVRRHNHLRIAQYHQHLAEKLDMEMSALLYMIREYPGNEEEKMRAAIGRFGLTGKAQVMPMKNLSDGQRSRVIFAWLAFRQPQLLLLDEPTNHLDIETIDSLAEALNEWDGGLVLVSHDFRLINQVARNIWVCENQAITPWQGDIMQFKAHLKKKAGLSD

SEQ ID NO: 6868 - protein, 597 aa, Malus domestica
MVSDASKKKAAQKKAAAAAKRGGKAAAAAASSKSPAAENGADKLANGVGAMHISDRNCTGVLCSHPLSRDIRIESLSVTFHGHDLIVDSELELNYGRRYGLLGLNGCGKSTLLTAIGLRELPIPDHMDIYHLSSEIEASDMSSLEAVISCDEERMRLEKEVEELAAQDDGGGEQLERIYERLEALDAATAEKRAAEILYGLGFDKKMQAKKTRDFSGGWRMRIALARALFINPTILLLDEPTNHLDLEACVWLEEMLKNFERILVVISHSQDFLNGVCTNIIHMQNKKLKMYTGNYDQYVQTRSELEENQMKQYKWEQEQIANMKEYIARFGHGSAKLARQAQSKEKTLAKMERGGLTEKVARDKILIFRFVDVGKLPPPVLQFVEVSFGYTPDNLIYKNIDFGVDLDSRIALVGPNGAGKSTLLKLMTGELFPSDGMVRRHNHLRIAQFHQHLAEKLDVELSALAYMIKEYPGNEEEKMRAAIGKFGLSGKAQVMPMKNLSDGQRSRVIFAWLAFRQPQLLLLDEPTNHLDIETIDSLAEALNEWDGGLVLVSHDFRLINQVAQEIWVCENQAVTRWGGDIMDFKQHLKIKAGLAD

SEQ ID NO: 6869 - protein, 598 aa, Euonymus alatus
MVSDASKKKVAQKKAAAAAKRGGKAAGSSKAKAASDSQNGGVAKVSDGLAAFHISDRTCTGVLCSHPLSRDIRIESLSVTFHGHDLIVDSELELNYGRRYGLLGLNGCGKSTLLTAIGCRELPIPDHMDIYHLSREIEASDMSSLEAVINCDEERLKLEREAEVLAAQDDGGGEALERLYERLESMDASTAEKRAAEILFGLGFNKEMQAKKTRDFSGGWRMRIALARALFMKPTVLLLDEPTNHLDLEACVWLEETLKKFDRILVVVSHSQDFLNGVCTNIIHMQSRKLKLYTGNYDQYVQTRSALEENQMKQYRWEQEQISSMKEYIARFGHGSAKLARQAQSKEKTLAKMERGGLTEKVARDSVLVFRFVDVGKLPPPVLQFVEVTFGYTPENLIYKNIDFGVDLDSRIALVGPNGAGKSTLLKLMTGDLFPIEGMVRRHNHLRIAQYHQHLAEKLDLELSALMYMMREYPGNEEEKMRAAIGKFGLTGKAQVMPMNNLSDGQKSRVIFAWLAYRQPQLLLLDEPTNHLDIETIDSLAEALNEWDGGMVLVSHDFRLINQVAKEIWVCENQAVTRWEGDIMDFKRHLKSKAGLFD

SEQ ID NO: 6870 - protein, 600 aa, Actinidia deliciosa
MVSDASKKKAAQKKAAAAAKRGGKAAAAATSSKAAADSQNGGGVNSLANGVDSLQISDRNCTGVLCSHPLSRDIRIESLSLTFHGHDLIVDSELELNYGRRYGLLGLNGCGKSTLLTAIGCRELPIPEHMDIYHLSREIEASDMSSLEAVISCDEERLRLEKEAEALAGQDDGGGEALERLYERLDAMDASTAEKRAAEILFGLGFNKKMQEKKTRDFSGGWRMRIALARALFINPTILLLDEPTNHLDLEACVWLEETLKKFDRILVVVSHSQDFLNGVCTNIIHMQSKSLKLYTGNYDQYVQTRSELEENQMKQYKWEQEQIASMKEYIARFGHGSAKLARQAQSKEKTLAKMERGGLTEKVARDKVLVFRFSDVGKLPPPVLQFVEVTFGYTPENLIYKNIDFGVDLDSRVALVGPNGAGKSTLLKLMTGDLVPLDGMVRRHNHLRIAQFHQHLGEKLDLELSALHFMIKEYPGNEEEKMRAAIGKFGLTGKAQIMPMKNLSDGQKSRVIFAWLAWRQPQMLLLDEPTNHLDIETIDSLADALNEWDGGLVLVSHDFRLINQVAHEIWVCENQAVTRWEGDIMAFKEHLRSKAGLSD

SEQ ID NO: 6871 - protein, 602 aa, Eucalyptus grandis
MVSDASKKKAAQKKAAAAAKRGGKAAAAATSSKAAAASAAEAQNGAGKLADGIGSMVISDRTCTGVLCSHPLSRDIRIESLSLTFHGHDLIVDSELELNYGRRYGLLGLNGCGKSTLLSAIGCRELPIPEHMDIYHLSREIEASDMSSLEAVISCDEERLQLEKEAEALAAQDDGGGEALDRLYERLEAMDAATAEKRAAEILYGLGFNKKMQAKKSRDFSGGWRMRIALARALFMNPTILLLDEPTNHLDLEACVWLEETLKKFERILVVVSHSQDFLNGVCTNIIHMQNKKLKIYTGNYDQYVQTRSELEENQMKQYKWEQEQISSMKEYIARFGHGSAKLARQAQSKEKTLAKMERGGLTERVVRDKVLVFRFPDVGKLPPPVLQFVEVTFGYTPDNLIYKNLDFGVDLDSRVALVGPNGAGKSTLLKLMTGDLVPLDGMVRRHNHLRIAQFHQHLTEKLDLDLPALQFMIKEYPGNEEEKMRAAIGKFGLTGKAQVMPMKNLSDGQRSRVIFAWLAWRQPHMLLLDEPTNHLDIETIDSLAEALNEWDGGLVLVSHDFRLINQVAHEIWVCENQAVTRWEGDIMEFKEHLRSKAGLSD

SEQ ID NO: 6872 - protein, 606 aa, Amsonia hubrichtii
MVSDASKKREAQKKAAAAAKRAGKSGASSKAVKEAAAAATATAAGENGSADNLANGVGALQISDRTCTGVLCSHPLSRDIRIESLSLTFHGHDLIVDSELELNYGRRYGLLGLNGCGKSTLLAAIGCRELPIPDHMDIYHLTREIEASDMTSLEAVINCDEERLKLEREAEALGAQEDGGGEQLERIYERLEALDAATAEKRAAEILYGLGFDKMMQAKKTRDFSGGWRMRIALARALFMNPTILLLDEPTNHLDLEACVWLEETLKKFDRILVVVSHSQDFLNGVCTNIIHMQNKKLKIYTGNYDQYVQTRAELEENQMKQYKWEQEQIASMKEYIARFGHGSAKLARQAQSKEKTLAKMERGGLTEKVIRDKVLVFRFHDVGKLPPPVLQFVEVAFGYTPDYLIYKNLDFGVDLDSRVALVGPNGAGKSTLLKLMTGDLVPTDGMVRRHNHLRIAQFHQHLTEKLDMEMSALQFMIKEYPGNEEEKMRAAIGKFGLSGKAQVMPMKNLSDGQRSRVIFAWLAWRQPHMLLLDEPTNHLDIETIDSLAEALNEWDGGLVLVSHDFRLINQVAQEIWVCENQAVKRWEGDIMDFKEHLRQKSGLFD

SEQ ID NO: 6873 - protein, 597 aa, Lotus japonicus
MVSDASKKKAAQKKAAAAAKRGGKAATAAASSKAAASDKAADKLANGIADMQISDRTCTGVLCSHPLSRDIRIESLSVTFHGHDLIVDSELELNYGRRYGLLGLNGCGKSTLLTAIGHRELPIPEHMDIYHLTREIEASDMSALEAVVSCDEERLRLEKEAETLAAQDDGGGETLERIYERLEALDASTAEKRAAEILHGLGFDKKMQAKKTRDFSGGWRMRIALARALFINPTILLLDEPTNHLDLEACVWLEESLKNFDRIMVVISHSQDFLNGVCTNIIHMQSKQLKMYTGNYDQYVQTRSELEENQMKQYKWEQEQISNMKEYIARFGHGSAKLARQAQSKEKTLAKMERGGLTEKVARDSVLVFRFVDVGKLPPPVLQFVEVSFGYTPDNLIYKNIDFGVDLDSRIALVGPNGAGKSTLLKLMTGELGPTDGMVRRHNHLRIAQYHQHLAEKLDMEMSALLYMMREYPGVEEEKMRAAIGKFGLSGKAQIMPMKNLSDGQRSRVIFAWLAYRQPQMLLLDEPTNHLDIETIDSLAEALNEWDGGLVLVSHDFRLINQVAHEIWVCENQAVKKWEGGIMDFKRHLKAKAGLSD

SEQ ID NO: 6874 - protein, 603 aa, Solanum phureja
MVSDASKKREAQKKAAAAAKRGGKSKAAVMKAAAAATATPAGRNDVDELTNGVGDIQLSDRTCTGVLCSHPLSRDIRIESLSLTFHGHDLIVDSELELNYGRRYGLLGLNGCGKSTLLSAIGCRELPIPDHMDIFHLTREIEASDMSSLQAVISCDEERLRLEKEVEVLAAQDDGGGEQLERIYERLEALDASTAEKRAAEILFGLGFNKKMQEQKTRDFSGGWRMRIALARALFMNPTILLLDEPTNHLDLEACVWLEETLKKFDRILVVVSHSQDFLNGVCTNIIHMQNKKLKLYTGNYDQYVQTREELEENQMKQYRWEQEQIASMKEYIARFGHGSAKLARQAQSKEKTLAKMERGGLTEKVAKDKVLVFRFPNVGKLPPPVLQFVEVTFGYTPDNLIYKNLDFGVDLDSRVALVGPNGAGKSTLLKLMTGELVPLDGMVRRHNHLRIAQFHQHLAEKLDMELSALQFMIKEYRGNEEEKMRASIGRFGLTGKAQVMPMKNLSDGQRSRVIFAWLAFRQPHMLLLDEPTNHLDIETIDSLAEALNEWDGGMVLVSHDFRLINQVAHEIWVCENQTVTRWEGDIMDFKLHLKARAGLGDE

SEQ ID NO: 6875 - protein, 593 aa, Sorghum bicolor
MVSDASKKKAAQKKAAAAAKRGAKVPAPSSSSSSSAAAKAVDAVAALKLSDRTCTGVLASHPLSRDIHIESLSLTFHGHDLIVDSELELNYGRRYGLLGLNGCGKSTLLTAIGCRELPIPEHMDIYHLTHEIEASDMSALQAVVSCDEERVKLEKEAEILAAQDDGGGDALDRVYERLEAIDASTAEKRAAEILYGLGFNKQMQAKKTRDFSGGWRMRIALARALFMNPTILLLDEPTNHLDLEACVWLEEMLKKFDRILVVISHSQDFLNGVCTNIIHMQNKKLKLYTGNYDQYVQTRSELEENQMKQFKWEQEQIASMKEYIARFGHGSAKLARQAQSKEKTLAKMERGGLTEKVVRDKILVFRFTNVGKLPPPVLQFVEVTFGYTPDNLLYKKLDFGVDLDSRIALVGPNGAGKSTLLKLMTGELAPLDGMVRRHNHLRIAQFHQHLAEKLDLDISALQYMMKEYPGNEEERMRAAVGKFGLSGKAQVMPMRNLSDGQRSRVIFAWLAYRQPQLLLLDEPTNHLDIETIDSLAEALNEWDGGLVLVSHDFRLINQVAHEIWVCENQAVTRWEGDIMDFKEHLRSKAGLSD

SEQ ID NO: 6876 - protein, 135 aa, Catharanthus roseus
MVSDASKKREAQKKAAAAAKRAGKSGASSKAAKEAAAAATATTAAAGENGTANDLASGVGALQISDRTCTGVLCSHPLSRDIRIESLSLTFHGHDLIVDSELELNYGRRYGLLGLNGWWESTLLTAIGCRELPIP

SEQ ID NO: 6877 - protein, 599 aa, Lippia dulcis
MVSDASKKKALQKKAAAAAKRGGKAAAAAASSKAAALENGNKVNNLASGVGDLQISDRTCTGVLCSHPLSRDIRIESLSLTFHGHELIVDSELELNYGRRYGLLGLNGCGKSTLLTAIGCRELPIPDHMDIFHLTREIEASDMSSLEAVISCDEERLQLEKEAEALAGQDDGGGEQLERIYERLDAMDASTAEKRAAEILFGLGFTKKMQEKKTRDFSGGWRMRIALARALFMNPTILLLDEPTNHLDLEACVWLEETLKKFERILVVVSHSQDFLNGVCTNIIHMQNKKLKIYTGNFDQYVQTRSELEENQMKQYRWEQEQIASMKEYIARFGHGSAKLARQAQSKEKTLAKMERGGLTEKVVRDKVLVFRFADVGKLPPPVLQFVDVTFGYTPDNLIYKNLDFGVDLDSRVALVGPNGAGKSTLLKLMTGDLVPLDGMVRRHNHLRIAQFHQHLTEKLDLDMSALAYMMKEYPGNEEEKMRAAVGRFGLTGKAQIMPMRNLSDGQRSRVIFAWLAFRQPQMLLLDEPTNHLDIETIDSLAEALNEWDGGLVLVSHDFRLINQVAHEIWVCENQAVTRWEGDIMDFKQHLRAKSGLFE

SEQ ID NO: 6878 - protein, 597 aa, Fragaria vesca
MVSDASKKKAAQKKAAAAAKRGGKAAAAASSKSASESQNGADKLANGVESMRISDRNCTGVLCSHPLSRDIRIESLSVTFHGHDLIVDSELELNYGRRYGLLGLNGCGKSTLLTAIGCRELPIPEHMDIFHLSREIEASDMSSLEAVISCDEERIRLEKEVEELAAQDDGGGEQLERIYERLEALDAATAEKRAAEILYGLGFDKQMQAKKTRDFSGGWRMRIALARALFINPTILLLDEPTNHLDLEACVWLEETLKKFERILVVVSHSQDFLNGVCTNIIHMQSKKLKIYSGNYDQYVQTRSELEENQMKQYKWEQEQISNMKEYIARFGHGSAKLARQAQSKEKTLAKMERGGLTEKVARDKILVFRFVDVGKLPPPVLQFVEVSFGYTPDNLIYKNIDFGVDLDSRVALVGPNGAGKSTLLKLMTGELTPLDGMVRRHNHLRIAQFHQHLTEKLDMELSALQFMIKEYPGNEEEKMRASIGKFGLTGKAQVMPMSNLSDGQRSRVIFAWLAFRQPQMLLLDEPTNHLDIETIDSLAEALNEWDGGLVLVSHDFRLINQVAHEIWVCENQAVTRWEGDIMQFKNHLKSKAGLGD

SEQ ID NO: 6879 - protein, 603 aa, Vinca minor
MVSDASKKREAQKKAAAAAKRAGKSGTSSKAVKEASAAAAAGENGNADNLADGVGALQISDRTCTGVLCSHPMSRDIRIESLSLTFHGHDLIVDSELELNYGRRYGLLGLNGCGKSTLLSSIGCRELPIPDHMDIFHLTREIEASDMSSLEAVINCDEERLKLEKEAEALAGQDDGGGEQLEHIYERLEALDAATAEKRAAEILFGLGFDKKMQAKKTRDFSGGWRMRIALARALFMNPTILLLDEPTNHLDLEACVWLEETLKNFDRILVVVSHSQDFLNGVCTNIIHMQNKKLKNYTGNYDQYVQTRSELEENQMKQYKWEQEQIASMKEYIARFGHGSAKLARQAQSKEKTLAKMERGGLTEKVARDQILVFRFPNVGKLPPPVLQFVEVSFGYTPENLIYKNIDFGVDLDSRVALVGPNGAGKSTLLKLMMGDLVPNDGMVRRHNHLRIAQFHQHLAEKLDLEMSALLFMIREYPGNEEEKMRAAIGKFGLSGKAQVMPMKNLSDGQRSRVIFAWLAFRQPHMLLLDEPTNHLDIETIDSLAEALNEWDGGLVLVSHDFRLINQVAHEIWVCENQAVKPWDGDIMGFKQHLRQKSGLYD

SEQ ID NO: 6880 - protein, 603 aa, Solanum lycopersicum
MVSDASKKREAQKKAAAAAKRGGKSKAAVMKAAAAATSTPSESNGVDELTNGVGEIQLSDRTCTGVLCSHPLSRDIRIESLSLTFHGHDLIVDSELELNYGRRYGLLGLNGCGKSTLLSAIGCRELPIPDHMDIFHLTREIEASDMSSLQAVISCDEERLRLEKEVEVLAAQDDGGGEQLERIYERLEALDASTAEKRAAEILFGLGFNKKMQEQKTRDFSGGWRMRIALARALFMNPTILLLDEPTNHLDLEACVWLEETLKKFDRILVVVSHSQDFLNGVCTNIIHMQNKTLKLYTGNYDQYVQTREELEENQMKQYRWEREQIASMKEYIARFGHGSAKLARQAQSKEKTLAKMERGGLTEKVAKDKVLVFRFPNVGKLPPPVLQFVEVTFGYTPENLIYKNLDFGVDLDSRVALVGPNGAGKSTLLKLMTGELVPLDGMVRRHNHLRIAQFHQHLAEKLDMELSALQFMIKEYPGNEEEKMRASIGRFGLTGKAQVMPMKNLSDGQRSRIIFAWLAFRQPHMLLLDEPTNHLDIETIDSLAEALNEWDGGMVLVSHDFRLINQVAHEIWVCENKTVTRWKGDIMDFKLHLKARAGLGDE

SEQ ID NO: 6881 - protein, 598 aa, Vinca minor
MVSDASKKREAQKKAAAAAKRAGKSGGSSKAAAAATTAGENGNADNLANGVGALHISDRTCTGILCSHPMSRDIRIESLSLTFHGHDLIVDSELELNYGRRYGLLGLNGCGKSTLLSSIGCRELPIPDHMDIFHLTREIEASDMSSLDAVMNCDEERLKLEKEAEALAGQDDGGGETLERIYERLEALDVATAEKRAAEILFGLGFDKKMQAKKTRDFSGGWRMRIALARALFMNPTILLLDEPTNHLDLEACVWLEETLKNFSRILVVVSHSQDFLNGVCTNIIHMQSKTLKIYTGNYDQYVQTRSELEENQMKQYKWEQEQISSMKEYIARFGHGSAKLARQAQSKEKTLAKMERGGLTEKVARDQVLVFRFPDVGKLPPPVLQFVDVSFGYTPENIIYKNLDFGVDLDSRVALVGPNGAGKSTLLKLMTGDLVPNDGMVRRHNHLRIAQFHQHLTEKLDMEMSALLFMIREYPGNEEEKMRGAIGKFGLTGKAQVMPMKNLSDGQRSRVIFAWLAFRQPHMLLLDEPTNHLDIETIDSLAEALNEWDGGLVLVSHDFRLINQVAHEIWVCENQAVKRWEGDIMGFKEHLKQKSGL

SEQ ID NO: 6882 - protein, 542 aa, Fragaria vesca
MVSDASKKKAAQKKAAAAAKRGGKAAAAASSKSASESQNGADKLANGVESMRISDRNCTGVLCSHPLSRDIRIESLSVTFHGHDLIVDSELELNYGRRYGLLGLNGCGKSTLLTAIGCRELPIPEHMDIFHLSREIEASDMSSLEAVISCDEERIRLEKEVEELAAQDDGGGEQLERIYERLEALDAATAEKRAAEILYGLGFDKQMQAKKTRDFSGGWRMRIALARALFINPTILLLDEPTNHLDLEACVWLEETLKKFERILVVVSHSQDFLNGVCTNIIHMQSKKLKIYSGNYDQYVQTRSELEENQMKQYKWEQEQISNMKEYIARFGHGSAKLARQAQSKEKTLAKMERGGLTEKVARDKILVFRFVDVGKLPPPVLQFVEVSFGYTPDNLIYKNIDFGVDLDSRVALVGPNGAGKSTLLKLMTGELTPLDGMVRRHNHLRIAQFHQHLTEKLDMELSALQFMIKEYPGNEEEKMRASIGKFGLTGKAQVMPMSNLSDGQRSRVIFAWLAFSNLRCFCWMSQLIIWILRQLTHWPRR

SEQ ID NO: 6883 - protein, 593 aa, Amborella trichopoda
  misc_feature (406)..(406): Xaa can be any naturally occurring amino acid
MVSDASKKKAAAKKAAAAAKRGGKSGAGASKAAEAQNGVDKLANGVGGIHLSDRTCTGVLCSHPLSRDIHIESLSVTFHGHDLIVDSELELNYGRRYGLLGLNGCGKSTLLAAIGCRELPIPEHMDIFHLTREIEASDLSALEAVVSCDEERLRLEKEVETLAAQDDGGGEALDRIYERLEAMDASTAEKRAAEILYGLGFSKQMQAKKTRDFSGGWRMRIALARALFMNPTILLLDEPTNHLDLEACVWLEETLKNFDRILVVVSHSQDFLNGVCTNIIHMQNKKLKLYTGNYDQYVQTRQELEENQMKQYRWEQEQIASMKEYIARFGHGSAKLARQAQSKEKTLAKMERGGLTEKVVRDKVLVFRFTDVGKLPPPVLQFVEIAFWYTPENIIYKKLDFGVDLXSRIALVGPNGAGKSTLLKLMAGDLEPKDGMVRRHNHLRIAQYHQHLAEKLDLEMSALQYMMKEYTGNEEEKMRAAIGKFGLTGKAQVMPMNNLSDGQRSRVIFAWLAWRQPHLLLLDEPTNHLDIETIDSLAEALNEWDGGMVLVSHDFRLINQVAKEIWVCENQVVTRWEGDIMDFKNHLKAKAEL

SEQ ID NO: 6884 - protein, 591 aa, Brachypodium distachyon
MVSDASKKKAAQKKAAAAAKRGSKASAASSSSAASAVDKAANGVSALNLSDRTCTGVLASHPLSRDIHIESLSLTFHGHDLIVDSDLELNYGRRYGLLGLNGCGKSTLLTAIGCRELPIPEHMDIYHLSREIEASDMSALQAVICCDEERIKLEKEAEILSAQDDGGGEALDLVYERLEAMDASTAEKRAAEILFGLGFDKQMQAKQTRDFSGGWRMRIALARALFMNPTILLLDEPTNHLDLEACVWLEEKLKNFERILVVISHSQDFLNGVCTNIIHMQNKILKLYTGNYDQYVQTRSELEENQMKQYKWEQEQIANMKEYIARFGHGSAKLARQAQSKEKTLAKMERGGLAEKVVNDKILVFRFTDVGKLPPPVLQFADVTFGYTPDNLIYKNLDFGVDLDSRVALVGPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 6885 - protein, 600 aa, Capsicum annuum
MVSDAAKKRDAQKKAAAAARRGGKGAATSKAAAAKGAAAESNGVDSLANGIGDLKISDRTCTGVLCSHPLSRDIRIESLSVTFHGHDLIVDSELELNYGRRYGLLGLNGCGKSTLLTAIGLRELPIPEHMDIFHLSREIEASDMTSLEAVINCDEERLQLEKEAEALAGRDDGGGEQLERIYERLEAMDAATAEKRAAEILFGLGFDKKMQAKKTRDFSGGWRMRIALARALFMNPTILLLDEPTNHLDLEACVWLEESLKNFERILVVISHSQDFLNGVCTNIIHMQNKKLKIYTGNYDQYVQTRSELEENQMKQYKWEQDQIAAMKEYIARFGHGSAKLARQAQSKEKTLAKMERGGLTEKVGRDSVLVFRFTDVGKLPPPVLQFSEVSFGYTPDNLIYKNLDFGVDLDSRIALVGPNGAGKSTLLKLMIGDLFPTDGMVKRHNHLKIAQYHQHLAEKLDMDMSALQYMMREYPGNEEEKMRAAIGRFGLTGKAQVMAMKNLSDGQRSRVIFAWLAYRVPHMLLLDEPTNHLDIETIDSLAEALNAWDGGMVLVSHDFRLINQVAHEIWVCENQAVTRWEGDIMDFKKHLKKRAGLGE

SEQ ID NO: 6886 - protein, 592 aa, Unknown
  Sequence found in Organisms: Pseudoroegneria spicata, Triticum aestivum
MVSDASKKKAAQKKAAAAAKRGAKSSAAASSSSASSAADKAANGIAALNLSDRTCTGVLASHPLSRDIHIESLSLTFHGHDLIVDSELELNYGRRYGLLGLNGCGKSTLLTAIGCRELPIPEHMDIHHLTREIEASDMSALQAVICCDEERVKLEKEAEILAAQDDGGGEALDLVYERLEAMDASTAEKRAAEILFGLGFDKQMQAKPTRDFSGGWRMRIALARALFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDRILVFRFTDVGKLPPPVLQFADVTFGYTPDNLIYKNLDFGVDLDSRVALVGPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 6887 - protein, 592 aa, Hordeum vulgare
MVSDASKKKAAQKKAAAAAKRGAKSNAAASSSSASSAADKAANGIAALNLSDRTCTGVLASHPLSRDIHIESLSLTFHGHDLIVDSELELNYGRRYGLLGLNGCGKSTLLTAIGCRELPIPEHMDIHHLTREIEASDMSALQAVICCDEERVKLEKEAEILAAQDDGGGEALDLVYERLEAMDASTAEKRAAEILFGLGFDKQMQAKPTRDFSGGWRMRIALARALFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDKILVFRFTDVGKLPPPVLQFADVTFGYTPDNLIYKNLDFGVDLDSRVALVGPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 6888 - protein, 592 aa, Leymus cinereus x Leymus triticoides
  misc_feature (41)..(41): Xaa can be any naturally occurring amino acid
MVSDASKKKAAQKKAAAAAKRGAKSSAAASSSSASSAADKXANGIAALNLSDRTCTGVLASHPLSRDIHIESLSLTFHGHDLIVDSELELNYGRRYGLLGLNGCGKSTLLTAIGCRELPIPEHMDIHHLTREIEASDMSALQAVICCDEERVKLEKEAEILAAQDDGGGEALDLVYERLEAMDASTAEKRAAEILFGLGFDKQMQAKPTRDFSGGWRMRIALARALFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDKILVFRFTDVGKLPPPVLQFADVTFGYTPDNLIYKNLDFGVDLDSRVALVGPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 6889 - protein, 592 aa, Avena sativa
MVSDASKKKAAQKKAAAAAKRGAKSSVAASSSSASAAADKAADSISALNLSDRTCTGVLASHPLSRDIHIESLSLTFHGHDLIVDSELELNYGRRYGLLGLNGCGKSTLLTAIGHRELPIPEHMDIHHLTREIEASDMSSLQAVICCDEERIKLEKEAEILSAQDDGGGEALDLVYERLEAMDASTAEKRAAEILFGLGFDKQMQAKPTRDFSGGWRMRIALARALFMNPTILLLDEPTNHLDLEACVWLEEKLKNFERILVVISHSQDFLNGVCTNIIHMQNKILKLYTGNYDQYVQTRSELEENQMKQYKWEQEQIAGMKEYIARFGHGSAKLARQAQSKEKTLAKMERGGLAEKVVNDKILVFRFTDVGKLPPPVLQFADVTFGYTPDNLIYKNLDFGVDLDSRVALVGPNGAGKSTLLKLMTGDLTPLDGMVRRHNHLRIAQFHQHLTEKLDLDMPALQYMMREYPGNEEEKMRASIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKRHLKKRAGL

SEQ ID NO: 6890 - protein, 592 aa, Triticum aestivum
MVSDASKKKAAQKKAAAAAKRGAKSSAAASSSSASSAADKAANGVAALNLSDRTCTGVLASHPLSRDIHIESLSLTFHGHDLIVDSELELNYGRRYGLLGLNGCGKSTLLTAIGCRELPIPEHMDIHHLTREIEASDMSALQAVICCDEERVKLEKEAEILAAQDDGGGEALDLVYERLEAMDASTAEKRAAEILFGLGFDKQMQAKPTRDFSGGWRMRIALARALFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDRILVFRFTDVGKLPPPVLQFADVTFGYSPDNLIYKNLDFGVDLDSRVALVGPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 6891 - protein, 594 aa, Chelidonium majus
MVSDASKKKAAQKKAAAAAKRGGKAAGAASSKTGSSTNGVDKLTNGVDSLHISDRTCTGVLCSHPLSRDIHIESLSVTFHGHDLIVDSELELNYGRRYGLLGLNGCGKSTLLTAIGCRELPIPEHMDIYHLSSEIEASDMSSLEAVINCDEEKLLLEKEVERLAAEDGGGGEALDRIYERLESLDASTAEMRAAQILFGLGFDKSMQAKKTRDFSGGWRMRIALARALFMKPTILLLDEPTNHLDLEACVWLEETLKNFDRILVVVSHSQDFLNGVCTNIIHMQSKKLKLYTGNYDQYVQTRSELEENQMKQYKWEQEQISNMKEYIARFGHGSAKLARQAQSKEKTLAKMERGGLTEKVSRDKVLIFRFTDVGKLPPPVLQFVEVSFGYTPENLIYKNIDFGGDLDSRVALVGPNGAGKSTLLKLMTGELMPQDGMVRRHNHLRIAQYHQHLTEKLDMEMSALQYMMKEYQGTGEEKMRAAIGQFGLTGKAQVMPMKNLSDGQKSRVIFAWLAWRQPQMLLLDEPTNHLDIETIDSLAEALNEWDGGLVLVSHDFRLINQVAHEIWVCENQKVTRWEGDIMGFKQHLKSKAGL

SEQ ID NO: 6892 - protein, 601 aa, Solanum phureja
MVSDAAKKRDAQKKAAAAARRGGKGAAASKSAATASKSAGESNGVDNLTNGVGDLQISDRTCTGVLCSHPLSRDIRIESLSVTFHGHDLIVDSELELNYGRRYGLLGLNGCGKSTLLTAIGLRELPIPDHMDIFHLSREIDASDMTSLEAVINCDEERLQLEKEAEALAAQDDGGGEQLERIYERLEAMDAATAEKRAAEILFGLGFDKKMQAKKTRDFSGGWRMRIALARALFMNPTILLLDEPTNHLDLEACVWLEESLKNFERILVVISHSQDFLNGVCTNIIHMQNKKLKLYTGNYDQYVQTRSELEENQMKQYKWEQEQISAMKEYIARFGHGSAKLARQAQSKEKTLAKMERGGLTEKVGRDSVLVFRFTDVGKLPPPVLQFSEVAFGYTPENLIYKNLDFGVDLDSRVALVGPNGAGKSTLLKLMIGELFPTDGMVKRHNHLKIAQYHQHLTEKLDMEVSALLYMMREYPGNEEEKMRAAIGRFGLTGKAQVMAMKNLSDGQRSRVIFAWLAFRQPHMLLLDEPTNHLDIETIDSLAEALNAWDGGMVLVSHDFRLINQVAHEIWVCENQAVTRWEGGIMEFKKHLKKRAGLGD

SEQ ID NO: 6893 - protein, 601 aa, Solanum lycopersicum
MVSDAAKKRDAQKKAAAAARRGGKGAAAPKSAATASKSAVESNGVDNLTNGVGDLQISDRTCTGVLCSHPLSRDIRIESLSVTFHGHDLIVDSELELNYGRRYGLLGLNGCGKSTLLTAIGLRELPIPDHMDIFHLSREIEASDMTSLEAVINCDEERLQLEKEAEALAGQDDGGGEQLERIYERLEAMDAATAEKRAAEILFGLGFDKKMQAKKTRDFSGGWRMRIALARALFMNPTILLLDEPTNHLDLEACVWLEESLKNFERILVVISHSQDFLNGVCTNIIHMQNKKLKLYTGNYDQYVQTRSELEENQMKQYKWEQEQISAMKEYIARFGHGSAKLARQAQSKEKTLAKMERGGLTEKVGRDSVLVFRFTDVGKLPPPVLQFSEVAFGYTPDNLIYKNLDFGVDLDSRIALVGPNGAGKSTLLKLMIGDLFPTDGMVKRHNHLKIAQYHQHLAEKLDMEVSALLFMMREYPGNEEEKMRAAIGRFGLTGKAQVMAMKNLSDGQRSRVIFAWLAFRQPHMLLLDEPTNHLDIETIDSLAEALNAWDGGMVLVSHDFRLINQVAHEIWVCENQAVTRWEGGIMDFKKHLKKRAGLGD

SEQ ID NO: 6894 - protein, 591 aa, Trigonella foenum-graecum
MVSDASKKKAAQKKAAAAAKRGGKAAVAAASSKAADKVADKISDMKISDRTCTGVLCSHPLSRDIRIESLSVTFHGHDLIVDTELELNYGRRYGLLGLNGCGKSTLLTAIGKRELPIPEHMDIHHLSREIDASDMSALEAVIACDEERLKLEREAETLAAQDDGGGEALERIYERLDALDASTAEKRAAEILHGLGFDKQMQAKKTRDFSGGWRMRIALARALFMNPTVLLLDEPTNHLDLEACVWLEESLKKFERILVVISHSQDFLNGVCTNIIHMQSKKLKIYTGNYDQYVQTRGDLEENQMKQYKWEQEQIANMKEYIARFGHGSAKLARQAQSKEKTLAKMERGGLTEKVVRDQVLVFRFTDVGKLPPPVLQFSEVSFGYTPDNLIYKNIDFGVDLDSRIALVGPNGAGKSTLLKLMTGDLFPSDGMVKRHNHLRIAQYHQHLAEKLDLDVPALQFMMNEYPGNEEEKMRAAIGRFGLTGKAQVMPMNNLSDGQKSRVIFAWLAWRQPQLLLLDEPTNHLDIETIDSLAEALNEWDGGLVLVSHDFRLINQVAHEIWVCADQKVTRWEGDIMDFKKHLKAKAGILD

SEQ ID NO: 6895 - protein, 599 aa, Podocarpus macrophillus
MVSDASKKKAAAKKAAAAAKRGSKSAAAASVAPSASQNGKAVAEVEKATSDMGEMRISDRTCTGVLCSHPQSRDIHIESLSVTFHGHDLVVDSELELNYGRRYGLLGLNGCGKSTLLTAIGCRELPIPEHMDIYHLTREIDATDMTSLDAVMNCDEERLRLEKEVEALAGQDDGGGEQLDRIYERLDALDAATAEKRAAEILFGLGFNKVMQAKKTRDFSGGWRMRIALARALFMNPTILLLDEPTNHLDLEACVWLEETLKNFDRILVVVSHSQDFLNGVCTNIIHMQNKKLKLYTGNYDQYVQTRSELEENQMKQYRWEQEQISSMKEYIARFGHGSAKLARQAQSKEKTLAKMERGGLTEKVVRDKVLVFRFTDVGKLPPPVLQFVEVTFGYTPGNLIYKNIDFGVDLDSRIALVGPNGAGKSTLLKLMTGDLTPSDGMVKRHNHLRIAQYHQHLTEKLDLEMAALQYMMHEYQGIEEEKMRAAIGKFGLTGKAQIMPMKNLSDGQRSRVIFAWLAWRLPHLLLLDEPTNHLDIETIDSLAEALNEWDGGLVLVSHDFRLINQVAKEIWVCENKTVTRWEGDIMDFKQHLKAKAGL

SEQ ID NO: 6896 - protein, 591 aa, Festuca arundinacea
VSDASKKKAAQKKAAAAAKRGAKSSVAASSSSATAAADKAADNLLALSLSDRTCTGVLASHPLSRDIHIESLSLTFHGHDLIVDSELELNYGRRYGLLGLNGCGKSTLLTAIGHRELPIPEHMDIHHLTCEIEASDMSALQAVICCDEERIKLEKEAEILSAQDDGGGEALDLVYERLEAMDASTAEKRAAEILFGLGFDKKMQAKPTRDFSGGWRMRIALARALFMNPTILLLDEPTNHLDLEACVWLEEKLKNFERILVVISHSQDFLNGVCTNIIHMQNKILKLYTGNYDQYVQTRSELEENQMKQYKWEQEQIAGMKEYIARFGHGSAKLARQAQSKEKTLAKMERAGLAEKVVNDKILVFRFTDVGKLPPPVLQFADVTFGYTPDNLIYKNLDFGVDLDSRVALVGPNGAGKSTLLKLMTGDLTPLDGMVRRHNHLRIAQFHQHLTEKLDLDMPALQYMMREYPGNEEEKMRAAIGKFGLSGKAQVMPMNNLSDGQKARVIFAWLAFRQPQMLLLDEPTNHLDIETIDSLAEALKEWDGGLVLVSHDFRLINQVAQEIWVCEKQAVTRWEGDIMDFKQHLKKRAGL

SEQ ID NO: 6897 - protein, 597 aa, Helianthus annuus
DASKKKALQKKAAAAAKRGGKAAAAATSAKAAAVGTMNGSSSSDNLSNGMGNLTISDRTCTGVLCSHPLSRDIRIESLSLTFHGHDLLVDTELELNYGRRYGLLGLNGCGKSTLLTSIGMRELPIPEHMDIFHLTREIEASDMSSLEAVMNCDEERLKLEAEAERLVGQDDGGGEALERVYERLDAMDASTAEKRAAEILNGLGFNKMMQAKKTRDFSGGWRMRIALARALFMNPTILLLDEPTNHLDLEACVWLEETLKKFERILVVVSHSQDFLNGVCTNIIHMQSKKLKMYTGNFDQYVQTRSELEENQMKQYKWEQDQIANMKEYIARFGHGSAKLARQAQSKEKTLAKMERGGLTEKVARDKVLVFRFVDVGKLPPPVLQFVEVTFGYTPDNLIYKNLDFGVDLDSRVALVGPNGAGKSTLLKLMTGELVPLDGMVRRHNHLRIAQYHQHLAEKLDLEMSALAYMMKEYPGNEEEKMRAAIGRFGLTGKAQVMPMKNLSDGQKSRVIFAWLAYRQPQMLLLDEPTNHLDIETIDSLAEALNEWDGGMVLVSHDFRLINQVANEIWVCENQTITRWEGDIMGFKEHLRNKAGL

SEQ ID NO: 6898 - protein, 598 aa, Aquilegia formosa
MVSDASKKKLAQKKAAAAAKRGGKASSAATSSKSGTSNGIGVDKITNGVDSLHISDRTCTGVLASHPMSRDIHIESLSLTFHGHDLIVDSELELNYGRRYGLLGLNGCGKSTLLTSIGCRELPIPEHMDIYHLSREIEASDMSALEAVINCDEERLQLEKEVEILAAEDGGGGEALERIYERLDALDASTAEKRAAEILFGLGFDKKMQSKKTRDFSGGWRMRIALARALFMNPTILLLDEPTNHLDLEACVWLEEMLKKFDRILVVVSHSQDFLNGVCTNIIHMQSKKLKFYSGNYDQYVQTRSELEENQMKQYKWEQEQISNMKEYIARFGHGSAKLARQAQSKEKTLAKMERGGLTEKVARDQVLVFRFTDVGKLPPPVLQFVEVKFGYTPENLIYKNLDFGVDLDSRVALVGPNGAGKSTLLKLMTGDLTPLDGMVKRHNHLKIGQYHQHLTEKLDLEMPALQFMMREYPGNEEEKMRAAIGKFGLTGKAQVMPMKNLSDGQKSRVIFAWLAWRQPQMLLLDEPTNHLDIETIDSLAEALKEWDGGLVLVSHDFRLINQVAKEIWVCEKQAVTRWEGDIMDFKAHLRRKAGLLD

SEQ ID NO: 6899 - protein, 598 aa, Aquilegia formosa
MVSDASKKKLAQKKAAAAAKRGGKASSAATSSKSGTSNGTGVDKITNGVDSLHISDRTCTGVLASHPMSRDIHIESLSLTFHGHDLIVDSELELNYGRRYGLLGLNGCGKSTLLTSIGCRELPIPEHMDIYHLSREIEASDMSALEAVINCDEERLQLEKEVEILAAEDGGGGEALERIYERLDALDASTAEKRAAEILFGLGFDKKMQSKKTRDFSGGWRMRIALARALFMNPTILLLDEPTNHLDLEACVWLEEMLKKFDRILVVVSHSQDFLNGVCTNIIHMQSKKLKFYSGNYDQYVQTRSELEENQMKQYKWEQEQISNMKEYIARFGHGSAKLARQAQSKEKTLAKMERGGLTEKVARDQVLVFRFTDVGKLPPPVLQFVEVKFGYTPENLIYKNLDFGVDLDSRVALVGPNGAGKSTLLKLMTGDLTPLDGMVKRHNHLKIGQYHQHLTEKLDLEMPALQFMMREYPGNEEEKMRAAIGKFGLTGKAQVMPMKNLSDGQKSRVIFAWLAWRQPQMLLLDEPTNHLDIETIDSLAEALKEWDGGLVLVSHDFRLINQVAKEIWVCEKQAVTRWEGDIMDFKAHLRRKAGLLD

SEQ ID NO: 6900 - protein, 482 aa, Tropaeolum majus
MVSDASKKKAAQKKAAAAAKRGGKAPATSKAAAPSDGSNGAASLSNGIDAMHISDRNCTGVLCSHPLSRDIRIESLSVTFHGHDLVVDTELELNYGRRYGLLGLNGCGKSTLLTSIGLRELPIPDHMDIYHLSREIEATDMSSLEAVMSCDEERLKLEKEAEVLAAQDDGGGEQLERLYERLDAMDASTAEKRAAEILFGLGFDKKMQAKKTRDFSGGWRMRIALARALFINPTILLLDEPTNHLDLEACVWLEETLKNFERILVVVSHSQDFLNGVCTNIIHMQSKKLKMYTGNYDQYVQTRSELEENQMKQYKWEQEQISNMKEYIARFGHGSAKLARQAQSKEKTLAKMERGGLTEKVSRDHILVFRFVDVGKLPPPVLQFVEVSFGYTPDSLIYKNIDFGVDLDSRVALVGPNGAGKSTLLKLMTGELTPSEGMVRRHNHLRIAQYHQHLTEKLDMDLSALAYMMKEYPGNEDESSSR

SEQ ID NO: 6901 - protein, 595 aa, Mimulus guttatus
MVSDASKKKAAQKKAAAAAKRGGKAVAVAASSKAAENGSKVDSLASGVGDLHISDRTCTGVLCSHPQSRDIRIESLSLTFHGHDLIVDSELELNYGRRYGLLGLNGCGKSTLLTSLGCRELPIPGHMDIYHLSREIEASDMSSLEAVMSCDEERLKLEREAEVLAAQDDGGGEPLERIYERLELMDSSTAEKRAAEILFGLGFDKKMQQKKTRDFSGGWRMRIALARALFMNPTILLLDEPTNHLDLEACVWLEEMLKNFDRILVVVSHSQDFLNGVCTNIIHMQSKKLKIYSGNYDQYVQTRSELEENQMKQYKWEQEQISSMKEYIARFGHGSAKLARQAQSKEKTLAKMERGGLTEKVARDSVLVFRFTDVGKLPPPVLQFSEVTFGYTPDNLIYKNLDFGVDLDSRIALVGPNGAGKSTLLKLMTGDLVPLDGMVRRHNHLRIAQYHQHLTEKLDVELSALEFMLKEYQGTEEEKMRSAVGRFGISGKAQTMPMKNLSDGQRSRVIFAWLAYRQPQMLLLDEPTNHLDIETIDSLAEALKEWDGGLVLVSHDFRLINQVAHEIWVCENQAVTRWEGGIMDFKRHLKAKAGL

SEQ ID NO: 6902 - protein, 602 aa, Helianthus annuus
MVSDASKKKALQKKAAAAAKRGGKAAAAATSAKAAAVGTMNGSSSSDNLSNGMGNLTISDRTCTGVLCSHPLSRDIRIESLSLTFHGHDLLLDTELELNYGRRYGLLGLNGCGKSTLLTSLGLRELPIPEQMDIFHLTREIEASDMSSLEAVMNCDEERLKLEEEAERLAGQDAGGGEALDRIYERLDAMDASTAEKRAAEILNGLGFNKQMQAKKTRDFSGGWRMRIALARALFMNPTVLLLDEPTNHLDLEACVWLEETLKKFERILVVVSHSQDFLNGVCTNIIHMQSRKLKMYTGNFDQYVQTRSELEENQMKQYKWEQDQIANMKEYIARFGHGSAKLARQAQSKEKTLAKMERGGLTEKVSRDKVLVFRFVDVGKLPPPVLQFVEVTFGYTPDTLIYKSIDFGVDLDSRVALVGPNGAGKSTLLKLMTGELVPLDGMVKRHNHLKIAQYHQHLAEKLDLEMSALLYMIREYPGNEEEKMRSAIGRFGLTGKAQVMPMKNLSDGQKSRVIFAWLAFRQPQMLLLDEPTNHLDIETIDSLAEALNEWDGGMVLVSHDFRLINQVAKEIWVCENQTITRWEGDIMGFKEHLRSKSGLYD

SEQ ID NO: 6903 - protein, 600 aa, Arnica chamissonis
MVSDASKKKALQKKAAAAAKRGGKAAAAATSAKAAAIGTMNGSSSSDNLSNGMGTLTISDRTCTGVLCSHPLSRDIRIESLSLTFHGHDLLVDTELELNYGRRYGLLGLNGCGKSTLLTSIGMRELPIPEQMDIFHLTREIEASDMSSLEAVMNCDEERLKLEAEAERLAAQDDGGGEPLERIYERLDAMDASTAEKRAAEILNGLGFDKKMQDKKTRDFSGGWRMRIALARALFMNPTVLLLDEPTNHLDLEACVWLEETLKNFERILVVVSHSQDFLNGVCTNIIHMQSKKLKMYTGNFDRYVQTRSELEENQMKQYKWEQDQIANMKEYIARFGHGSAKLARQAQSKEKTLAKMERDGLTEKVTRDSVLVFRFVDVGKLPPPVLQFVEVSFGYTPDNLIYKNLDFGVDLDSRVALVGPNGAGKSTLLKLMTGELVPLDGMVRRHNHLRIAQYHQHLAEKLDLEMSALLYMMREYPGNEEEKMRASIGRFGLTGKAQVMPMKNLSDGQKSRVIFAWLAFRQPQMLLLDEPTNHLDIETIDSLAEALKEWDGGLVLVSHDFRLINQVAQEIWVCENQTITRWGGDILAFKEHLRAKAGL

SEQ ID NO: 6904 - protein, 607 aa, Cephalotaxus harringtonia
MVSDASKQRAAAKKAAAAAKRGAKSAVAAAPKSDAAPSKLSDVSQNGKASASVDKAADELAALSISDRTCTGVLCSHPLSRDIHIESLSVTFHGHELIVDSELELNYGRRYGLLGLNGCGKSTLLTALGCREIPIPEHMDIYHLTREIEATDMTSLEAVMNCDEERLKLEKEAEALAAKDDGGGEALDRIYERLELLDAATAEKRAAEILFGLGFTKKMQAKKTRDFSGGWRMRIALARALFMNPTILLLDEPTNHLDLEACVWLEETLKKFDRILVVISHSQDFLNGVCTNIIHMQNKKLKLYTGNYDQYVQTRSELEENQMKQYRWEQEQISSMKEYIARFGHGSAKLARQAQSKEKTLAKMERGGLTEKVVRDKVLVFRFTDVGKLPPPVLQFVEVDFGYTPENLIYKNVDFGVDLDSRIALVGPNGAGKSTLLKLMTGELTPLDGMVKRHNHLRIAQYHQHLTEKLDLEMSALQYMMHEYNGIEEEKMRAAIGKFGLTGKAQIMAMKNLSDGQKSRVIFAWLAWRLPHLLLLDEPTNHLDIETIDSLAEALNEWDGGLVLVSHDFRLINQVAKEIWVCENKSITRWEGDIMDFKQHLKSKAGL

SEQ ID NO: 6905 - protein, 559 aa, Cajanus cajan
KAADKLADGIGDIQISDRTCTGVLCSHPLSRDIRIESLSVTFHGHDLIVDTELELNYGRRYGLLGLNGCGKSTLLTAIGCRELPIPDHMDIYHLTREIEASDMSALEAVISCDEERLRLEKEAEALAAQDDGGGETLERIYERLEAMDASTAEKRAAEILFGLGFNKQMQAKKTRDFSGGWRMRIALARALFMNPTILLLDEPTNHLDLEACVWLEENLKKFDRILVVISHSQDFLNGVCTNIMHMQNKKLKLYTGNYDQYVQTRAELEENQMKQYKWEQEQISSMKEYIARFGHGSAKLARQAQSKEKTLAKMERGGLTEKVVRDKVLVFRFVDVGKLPPPVLQFVEVTFGYTPDNLIYKNLDFGVDLDSRIALVGPNGAGKSTLLKLMTGDLVPIDGMVRRHNHLRIAQFHQHLAEKLDLELSALQFMIKEYPGNEEERMRAAIGKFGLSGKAQVMPMKNLSDGQRSRVIFAWLAYRQPHLLLLDEPTNHLDIETIDSLAEALNEWDGGMVLVSHDFRLINQVAHEIWVCADQAVTRWEGDIMDFKEHLRSKAGLSD

SEQ ID NO: 6906 - protein, 597 aa, Triphysaria pusilla
MVSDASKKKAAQKKAAAAAKRGGKAAASASSKAATSANGSKADSLANGVADLHISDRNCTGVLCSHPLSRDIRIESLSLTFHGHDLIVDSELELNYGRRYGLLGLNGCGKSTLLSSIGCRELPIPDHMDIFHLTREIEASDMSSLEAVISCDEERLKLEKEVEELSGQDDGGGEALERIYERLDALDVATAEKRAAEILFGLGFDKKMQAKKTRDFSGGWRMRIALARALFMNPTILLLDEPTNHLDLEACVWLEETLKKFERILVVVSHSQDFLNGVCTNIIHMQSKKLKIYTGNFDTYIQTRSDLEENQMKQFKWEQEQIANMKEYIARFGHGSAKLARQAQSKEKTLAKMERGGLTEKVVRDQVLVFRFVDVGKLPPPVLQFSEVTFGYTPDNLIYKNIDFGVDLDSRVALVGPNGAGKSTLLKLMTGELHPLDGMVRRHNHLRIAQFHQHLTEKLDLELSALEFMLREYPGNEEDKMRAAVGRFGLTGKAQVMAMQNLSDGQKARVIFAWLAWRQPNMLLLDEPTNHLDIETIDSLAEALKEWDGGLVLVSHDFRLINQVAHEIWVCEKQAVTRWEGDIMDFKKHLKAKSGLA

SEQ ID NO: 6907 - protein, 593 aa, Zostera marina
MVSDASKKKAAQKKAAAAAKRGGKAAATSSKSKTNGVAEVSSKIGSLQISDRNCTGVLCSHPLSRDIHIESLSVTFHGHDLIVDSDLELNYGRRYGLLGLNGCGKSTLMTALGKRELPIPEHMDIFHLTREIEASDMTALEAVVNCDEEKLKLEKEAEMLAAEDGGGGDALDMIYERLEALDASTAEKRAAEILNGLGFNKQMQGKMTRDFSGGWRMRIALARALFMNPTILLLDEPTNHLDLEACVWLEELLKNFERILVVVSHSQDFLNGVCTNIIHMQSKKIKIYSGNYDQYVQTRSELEENQMKQYKWEQEQISSMKEYIARFGHGSAKLARQAQSKEKTLAKMERGGLTEKVTRDSVLVFNFTDVGKLPPPVLQFVDVAFGYTPENLIYKCLNFGVDLDSRIALVGPNGAGKSTLLKLMTGDLTPSDGMVRRHNHLRIAQFHQHLAEKLDVELSALAYMMQEYPGNSEEKMRAIVGRFGLSGKTQIMPMKNLSDGQRSRVIFAWLAWRLPHMLLLDEPTNHLDIETIDSLADALKQWDGGLVLVSHDFRLINQVAEEIWVCEDQAVTRWNGDIMGFKLHLRKKAGLFD

SEQ ID NO: 6908 - protein, 607 aa, Sequoia sempervirens
MVSDASKQRAAAKKAAAAAKRGAKSAAVTAPKSEAASSTSVEPSQNGKASASVDKAADEIAAMAISDRTCTGVLCSHPLSRDIHIESLSVTFHGHELIVDSELELNYGRRYGLLGLNGCGKSTLLTALGMRELPIPEHMDIYHLTREIEATDMTSLEAVMNCDEERLKLEKEAEALAGQDDGGGEALDRIYERLELMDAATAEKRAAEILFGLGFTKKMQAQKTRDFSGGWRMRIALARALFMNPTILLLDEPTNHLDLEACVWLEETLKKFDRILVVVSHSQDFLNGVCTNIIHMQNKKLKLYTGNYDQYVQTRAELEENQMKQYRWEQEQISSMKEYIARFGHGSAKLARQAQSKEKTLAKMERGGLTEKVVRDQVLVFRFTDVGKLPPPVLQFVEVDFGYTPENLIYKSADFGVDLDSRVALVGPNGAGKSTLLKLMTGDLTPLDGMVKRHNHLRIAQYHQHLTEKLDLEMSALQYMMHEYNGIEEEKMRAAIGKFGLTGKAQIMPMKNLSDGQKSRVIFAWLAWRLPHLLLLDEPTNHLDIETIDSLAEALNEWDGGLVLVSHDFRLINQVAKEIWVCENKSITRWQGDIMDFKQHLKSKAGL

SEQ ID NO: 6909 - protein, 580 aa, Zea mays
MVSDAAAAKRGAKVPTPSSSSSADAKSIGAVAALKLSDRTCTGVLASHPLSRDIHIESLSLTFHGHDLIVDSELELNYGRRYGLLGLNGCGKSTLLTAIGCRELPIPEHMDIYHLTHEIEASDMSALQAVVCCDEERMKLEKEAEILAAQDDGGGDALDRVYERLEAIDASTAEKRAAEILYGLGFNKQMQAKKTRDFSGGWRMRIALARALFMNPTILLLDEPTNHLDLEACVWLEETLKKFDRILVVISHSQDFLNGVCTNIIHMQNKKLKLYTGNYDQYIQTRSELEENQMKQFRWEQEQIASMKEYIARFGHGSAKLARQAQSKEKTLAKMERGGLTEKVVRDKILVFRFTNVGKLPPPVLQFVEVTFGYTPDNLLYKKLDFGVDLDSRIALVGPNGAGKSTLLKLMTGELVPLDGMVRRHNHLRIAQFHQHLAEKLDLDMSALQYMMKEYPGNEEERMRAAVGKFGLSGKAQVMPMRNLSDGQRSRVIFAWLAYRQPQLLLLDEPTNHLDIETIDSLAEALNEWDGGLVLVSHDFRLINQVAHEIWVCENQAVTRWEGDIMDFKEHLRSKACLSD

SEQ ID NO: 6910 - protein, 428 aa, Solanum tuberosum
MVSDAAKKRDAQKKAAAAARRGGKGAAASKSAATASKSAGESNGVDNLTNGVGDLQISDRTCTGILCSHPQSRDIRIESLSVTFHGHDLIVDSELELNYGRRYGLLGLNGCGKSTLLTAIGLREIPIPDHMDIFHLSREIEASDMTSLEAVINCDEERLQLEKEAEALAAQDDGGGEQLERIYERLEAMDAATAEKRAAEILFGLGFDKKMQAKKTRDFSGGWRMRIALARALFMNPTILLLDEPTNHLDLEACVWLEESLKNFERILVVISHSQDFLNGVCTNIIHMQNKKLKLYTGNYDQYVQTRSELEENQMKQYKWEQEQISAMKEYIARFGHGSAKLARQAQSKEKTLAKMERGGLTEKVGRDSVLVFRFTDVGKLPPPVLQFSEVAFGYTPDNLIYKNLDFGVDLDSRVALVGPNGAGKNTA

SEQ ID NO: 6911 - protein, 368 aa, Taxus baccata
MVSDASKQRAAAKKAAAAAKRGAKSAVVVAPKSEAAPSKSSDASQNGKTSASVDKAADEMAAMAISDRTCTGVLCSHPLSRDIHIESLSVTFHGHELIFDSELELNYGRRYGLLGLNGCGKSTLLTALGFRELPIPEHMDIYHLTREIEATDMTSLEAVMNCDEERLKLEKEAEALAGQDDGGGEALDRIYERLELLDAATAEKRAAEILFGLGFTKKMQAKMTRDFSGGWRMRIALARALFMNPTILLLDEPTNHLDLEACVWLEETLKKFDRILVVISHSQDFLNGVCTNIIHMQNKKLKLYTGNYDQYVQTRSELEENQMKQYRWEQEQISSMKEYIARFGHGSAKLARQAQSKEKPWQRWKEVG

SEQ ID NO: 6912 - protein, 361 aa, Triticum aestivum
  misc_feature (5)..(5): Xaa can be any naturally occurring amino acid
  misc_feature (27)..(27): Xaa can be any naturally occurring amino acid
  misc_feature (33)..(33): Xaa can be any naturally occurring amino acid
MSLPXILHLEACVWLEETLKKFDRILXVISHSXDFLNGVCTNIIHMQNRKLKLYTGNFDQYVQTRSELEENQMKQYRWEQDQIASMKEYIARFGHGSAKLARQAQSKEKTLAKMERGGLTEKVARDRILTFRFANVGKLPPPVLQFVEVTFGYTPDNLIYKKLDFGVDLDSRVALVGPNGAGKSTLLKLMTGELVPLDGMVRRHNHLRIAQFHQHLAEKLDLDLSALQYMLNEYPGNEEERMRAAIGRFGLSGKAQVMPMRNLSDGQRSRVIFAWLAWREPQMLLLDEPTNHLDIETIDSLAEALNEWDGGLVLVSHDFRLINQVAQEIWVCEKQAVTRWEGDIMEFKEHLKSKSGGMSDD

SEQ ID NO: 6913 - protein, 595 aa, Hordeum vulgare
MVSDASKKKAAQKKAAAAAKRGAKVPTSSSSSSSASTKKVADALAAVHLSDRTCTAVLTSHPLSRDIHIESLTLTFHGHDLLVDTELELNYGRRYGLLGLNGCGKSCLLKAIGCRELPIPEHMDIYHLSHEIEASDMSALGAVISCDEERVKLEKEAEVLAAQDDGGGAALERVYERLEAIDASTAEKRAAEILFGLGFNKQMQAKKTRDFSGGWRMRIALARALFMNPTILLLDEPTNHLDLEACVWLEETLKKFDRILVVISHSQDFLNGVCTNIIHMQNRKLKLYTGNFDQYVQTRSELEENQMKQYRWEQDQIASMKEYIARFGHGSAKLARQAQSKEKTLAKMERGGLTEKVARDRILTFRFANVGKLPPPVLQFVEVTFGYTPDNLIYKKLDFGVDLDSRVALVGPNGAGKSTLLKLMTGELVPLDGMVRRHNHLRIAQFHQHLAEKLDLDLSALQYMLNEYPGNEEERMRAAIGRFGLSGKAQVMPMRNLSDGQRSRVIFAWLAWREPQMLLLDEPTNHLDIETIDSLAEALNEWDGGLVLVSHDFRLINQVAQEIWVCENQAVTRWEGGIMEFKEHLKSKSGGMSED

SEQ ID NO: 6914 - protein, 364 aa, Pteridium aquilinum
MVSDASKKKAAQKKAAAAAKRGSKATSTIATSSKTNGASNNALNEVADEMGSLQITDRTCTGVLASHPQSRDIHIESLSVTFHGHDLIVDSSLELNYGRRYGLLGLNGCGKSTLLASIGCRELPIPEHMDIYHLSREIEATDLTSLQAVVNVDEERIQLEKEAELLSAQDDGGGEVLERLYERLEAMDASTAEKRAAEILYGLGFTKSMQQKKTRDFSGGWRMRIALARALFMNPTILLLDEPTNHLDLEACVWLEETLKKFDRILVVVSHSQDFLNGVCTNIIHMQNKSLKFYTGNYDQYVQTREELEENQMKQYKWEQEQISNMKEYIARFGHGSAKLARQAQSKEKTLAKNGKRRSYREGC

SEQ ID NO: 6915 - protein, 368 aa, Gnetum gnemon
MVSDASKKRAQAKKQTAAMKRGSKAGAAAATAASSTKKVTDEMAEMRISDRTCTGVLSSHPLSRDIHIESLSVTFHGHELIVDSELELNYGRRYGLLGLNGCGKSTLLTALGLRELPIPDHMDIFHLTREIEATDMSALAAVINCDEERLRLEREAEALASREDGGGEQLERIYERLDAMDAATAEKRAAEILFGLGFNKAMQAKKTRDFSGGWRMRIALARALFMNPTVLLLDEPTNHLDLEACVWLEECLKKFDRILVVISHSQDFLNEVCTNIIHMQNKKLKFYTGNYDQYVQTRAELEENQMKQYKWEQEQIASMKDYIARFGHGSAKLARQAQSKEKTLAKMEREGLTERVVRDKVLVFVLLM

SEQ ID NO: 6916 - protein, 474 aa, Beta vulgaris
  misc_feature (255)..(255): Xaa can be any naturally occurring amino acid
  misc_feature (276)..(276): Xaa can be any naturally occurring amino acid
  misc_feature (321)..(321): Xaa can be any naturally occurring amino acid
  misc_feature (324)..(324): Xaa can be any naturally occurring amino acid
  misc_feature (429)..(432): Xaa can be any naturally occurring amino acid
  misc_feature (434)..(434): Xaa can be any naturally occurring amino acid
  misc_feature (447)..(447): Xaa can be any naturally occurring amino acid
  misc_feature (449)..(449): Xaa can be any naturally occurring amino acid
  misc_feature (455)..(456): Xaa can be any naturally occurring amino acid
  misc_feature (469)..(469): Xaa can be any naturally occurring amino acid
  misc_feature (471)..(471): Xaa can be any naturally occurring amino acid
MVSDASKKKAAQKKAAAAAKRGGKAAATSKAAAAVAQSVDKLADGVSDIQISDRNCTGVLCSHPMSRDVRIESLSVTFHGHDLIVDSILELNYGRRYGLLGLNGCGKSTLLTAIGLRELPIPEHMDIYHLSREIEASDMSALEAVMSCDEERVKLEQEVEVLLAQDDGGGERLERVYERLEALDVATAEKRAAEILHGLGFDKMMQAKKTRDFSGGWRMRIALARSLFMNPTILLLDEPTNHLDLEACVWLEENXKNFSRILVVVSHSQDFLNGVXTNIIHMQSKQLKMYTGNYDQYVQTRSELEENQMKQYKWEQEQISXMKXYIARFGHGSAKLARQAQSKEKTLAKMERGGLTEKVVRDKVLVFRFTDVGKLPPPVLQFVDVSFGYTPEHILYKHLDFGVDLDSRIALVGPNGAGKSTLLKLMTGXXXXEXRCGAQSLRIAQSXSXGRKAGXXMPALLYMMRDIQXPXKRK

SEQ ID NO: 6917 - protein, 595 aa, Brachypodium distachyon
MVSDASKKKAAQKKAAAAAKRGAKVPSSTSSSSSSASAKAAADALAAIHLSDRTCTAVLTSHPLSRDIHIESLTLTFHGHDLLVDTELELNYGRRYGLLGLNGCGKSCLLKAIGCRELPIPEHMDIYHLSHEIEASEMSALEAVISCDEERVKLEKEAEVLAAQDDGGGEALERVYERLEAIDVSTAEKRAAEILFGLGFNKQMQAKKTRDFSGGWRMRIALARALFMNPTILLLDEPTNHLDLEACVWLEETLKKFERILVVISHSQDFLNGVCTNIIHMQNRKLKLYTGNFDQYVQTRAELEENQMKQFRWEQEQIASMKEYIARFGHGSAKLARQAQSKEKTLAKMERGGLTEKVARDRILTFRFTDVGNLPPPVLQFVEVTFGYTEDNLIYKKLDFGVDLDSRVALVGPNGAGKSTLLKLMTGELVPLDGMVRRHNHLRIAQFHQHLAEKLDLDLSALQYMMNEYPGNGEERMRAAIGRFGLSGKSQVMPMRNLSDGQRSRVIFAWLAWREPQLLLLDEPTNHLDIETIDSLAEALNEWDGGLVLVSHDFRLINQVAQEIWVCEKQAVTRWEGDIMEFKEHLRNKSGLSDD

SEQ ID NO: 6918 - protein, 597 aa, Adiantum capillus-veneris
MVSDASKKKAAQKKAAAAAKRGSKATATTAASSKTNGVSNSTSNEVADEIASMQITDRTCTGILASHPQSRDIHIESLSVTFHGHDLIVDSSLELNYGRRYGLLGLNGCGKSTLLASIGCRELPIPDHMDIYHLTREIEATDLTSLQAVVNVDEERVKLEKEAELLAAQDDGGGEVLERLYERLEAMDAATAEKRAAEILYGLGFTKSMQQKKTRDFSGGWRMRIALARALFMNPTILLLDEPTNHLDLEACVWLEETLKKFDRILVVVSHSQDFLNGVCTNIIHMQSKKLKFYTGNFDQYLQTREELEENQMKQYKWEQEQIANMKEYIARFGHGSAKLARQAQSKEKTLAKMERGGLTEKVARDKVLVFRFTDVGKLPPPVLQFVEVDFGYTPEHMIYRKLDFGVDLDSRVALVGPNGAGKSTLLKLMTGELAPIDGMVRRHNHLRIAQFHQHLADKLNLDVPALQYMMSEYPGLEEEKMRAAIGRFGLTGKAQIMPMRNLSDGQRSRVIFAWLAWRLPHMLLLDEPTNHLDIETIDALADALNEWDGGLVLVSHDFRLINQVAKEIWVCENQSVTRWEGDIMDFKQHLKAKAGL

SEQ ID NO: 6919 - protein, 561 aa, Orobanche aegyptiaca
ENGSKFDDLASGVGDLHISDRTCTGVLCSHPLSRDIRIESLSLTFHGHDLIVDSELELNYGRRYGLLGLNGCGKSTLLSAIGCRELPIPEHMDIFHLTREIEASDMSSLEAVISCDEERLKLEKEAEVLAGQDDGGGAALERIYERLDALDASTAEKRAAEILFGLGFDKKMQAKKTRDFSGGWRMRIALARALFMNPTVLLLDEPTNHLDLEACVWLEEMLKKFERILVVVSHSQDFLNGVCTNIIHMQSKKLKIYTGNFDQYLQTRSELEENQMKQYKWEQEQISSMKEYIARFGHGSAKLARQAQSKEKTLAKMERGGLTEKVARDKVLIFRFVDVGKLPPPVLQFVEVTFGYTPDNLIYKNIDFGVDLDSRVALVGPNGAGKSTLLKLMTGDLVPLDGMVRRHNHLRIAQFHQHLTEKLDLELSALQFMLKEYPGNEEEKMRGAVGKFGLSGKAQVMPMKNLSDGQKSRVIFAWLAYRQPQMLLLDEPTNHLDIETIDSLAEALNEWDGGLVLVSHDFRLINQVAHEIWVCENQKVTRWGGDIMDFKAHLKAKAGLA

SEQ ID NO: 6920 - protein, 582 aa, Plantago ovata
QKKAAAAAKRGGKAVAASSKADNGSSKADSLANGVGELHISDRTCTGVLCSHPMSRDIRIESLSLTFHGHDLIVDSELELNYGRRYGLLGLNGCGKSTLLTSIGMRELPIPDHMDIYHLSREIDASDMSSLEAVINCDEERMKLEQEAEALAGQDDGGGDKLDMIYERLEAMDAATAEKRAAEILFGLGFDKKMQAKKTRDFSGGWRMRIALARALFMNPTILLLDEPTNHLDLEACVWLEEMLKNFNRILVVVSHSQDFLNGVCTNIIHMQSKKLKMYTGNFDQYVQTRTEQEENQMKQYKWEQDQIANMKEYIARFGHGSAKLARQAQSKEKTLAKMERGGLTEKVARDKVLIFNFTDVGKLPPPVLQFVEVKFGYTPDNLIYKSIDFGVDLDSRVALVGPNGAGKSTLLKLMTGELVPLDGMVRRHNHLRIAQYHQHLAEKLDLDMSALQYMMREYPGTEEEKMRAAVGRFGLTGKAQVMPMKNLSDGQKSRVIFAWLAYRVPHMLLLDEPTNHLDIETIDSLADALNEWDGGMVLVSHDFRLINQVAHEIWVCENQSVTRWEGDIMDFKAHLKAKSGL

SEQ ID NO: 6921 - protein, 570 aa, Coffea canephora
MVSDASKKRDAQKKAAAAAKRGGKSAAASSKAAKEVAAAAAAATTAAENGSADSLANGVGMLQISDRTCTGVLCSHPLSRDIRIESLSLTFHGHDLIVDSELELNYGRRYGLLGLNGCGKSTLLAAIGCRELPIPDHMDIYHLTREIEASDISSLEAVINCDEERLKLEKEAEALAGQDDGGGEQLERVYERLEAMDAATAEKRAAEILFGLGFTKKMQEMKTRDFSGGWRMRIALARALFMNPTILLLDEPTNHLDLEACVWLEETLKKFDRILVVVSHSQDFLNGVCTNIIHMQGKKLKPYTGNYDQYVQTRAELEENQMKQYKWEQEQIASMKEYIARFGHGSAKLARQAQSKEKTLAKMERGGLTEKVARDKVLVFRFTDVGKLPPPVLQFVEVSFGYTPDNLIYKNLDFGVDLDSRVALVGPNGAGKSTLPKLMTGDLVPLDGMVRRHNHLRIAQFHQHLAEKLDLEMPALQFMIKEYPGNEEERMRAAIGKFGLSGKAQVMPMKNLSDGQRSRVIFAWLAWRQPHMLLLDEPTNHLDIETIDSLAEALNEWDGGLVLVSHDFRL

SEQ ID NO: 6922 - protein, 492 aa, Centaurea maculosa
  misc_feature (6)..(7): Xaa can be any naturally occurring amino acid
  misc_feature (14)..(14): Xaa can be any naturally occurring amino acid
  misc_feature (87)..(87): Xaa can be any naturally occurring amino acid
  misc_feature (115)..(115): Xaa can be any naturally occurring amino acid
MAAGNXXSYFIGMXELPIPEHMDIFHLTREIDASDMSSLEAVMNCDEERLKLEAEAELLAGQDAGGGEALERIYERLDAMDANTAEXRAAEILNGLGFDKKMQAKKTRDFSGGWXMRIALARALFMNPTILLLDEPTNHLDLEACVWLEETLKNFERILVVVSHSQDFLNGVCTNIIHMQSKKLKMYTGNFDQYVQTRSELEENQMKQYKWEQDQIAGMKEYIARFGHGSAKLARQAQSKEKTLAKMERGGLTEKVARDKVLVFRFVDVGKLPPPVLQFVEVSFGYTPDNLIYKCLDFGVDLDSRVALVGPNGAGKSTLLKLMTGELHPLDGMVRRHNHLRIAQYHQHLAEKLDLDMSALLYMMREYPGNEEEKMRASIGRFGLTGKAQVMPMKNLSDGQKSRVIFAWLAFRQPQMLLLDEPTNHLDIETIDSLAEALNEWDGGLVLVSHDFRLINQVAHEIWVCENQAVTRWEGDIMGFKEHLKTKAGLSG

SEQ ID NO: 6923 - protein, 597 aa, Physcomitrella patens
MVSDASKKKAAAKKAAAAEKRGSKSAAAVAQSKLKEVQAGATAESLAEEMAAARITDRTCTGVLASHPQSRDIHIESLSVTFHGHELVSDSTLELNYGRRYGLLGLNGCGKSTLLTAIGLREVPIPEHMDIYHLTKEIDATDLTALEAVKNVDEERLKLEKEAEKLAAQDDGGGELLDRIYERLELMDSATAEMRAAQILHGLGFTKKMQAKKTRDFSGGWRMRIALARALFMNPTILLLDEPTNHLDLEACVWLEETLKKFDRILVVVSHSQDFLNGVCTNIIHMQSKKLKFYTGNYDQYCQTRAELEENQMKQYRWEQEQIAGMKEYIARFGHGSAKLARQAQSKEKTLAKMERGGLTEKVVKDKVLTFRFTDVGKLPPPVLQFVDLTFGYTPDQLIYEKVDFGVDLDSRIALVGPNGAGKSTLLKLMTGDVTPTDGMVRRHNHLRIAQYHQHLTEKLSLEMSALQYMMSEYPGLEEEKMRAAIGRFGLTGKAQIMPMGNLSDGQKSRVIFAWLAWRLPHLLLLDEPTNHLDIETIDSLAEALNEWDGGMVLVSHDFRLINQVAKEIWVCEKKSITKWNGDIMDFKRHLKKSAGL

SEQ ID NO: 6924 - protein, 597 aa, Physcomitrella patens
MVSDASKKKAAAKKLAAAEKRGSKSAAVVAQTKLKDVTNGTSADTLAEELAAANITDRTCTGVLASHAQSRDIHIESLSVTFHGHELVADSTLELNYGRRYGLLGLNGCGKSTLLTAIGLREVPIPEHMDIYHLTREIDATDMTALQAVMNVDSERLLLEKEAEKLSQQDDGGGEPLERIYERLEAMDSATAEMRAAQILHGLGFTKKMQNKKTRDFSGGWRMRIALARALFMNPTILLLDEPTNHLDLEACVWLEETLKKFERILVVVSHSQDFLNGVCTNIIHMQNKQLKFYTGNYDQYCQTRAELEENQMKQYRWEQEQISAMKEYIARFGHGSAKLARQAQSKEKTLAKMERGGLAEKVVRDKVLTFRFTDVGKLPPPVLQFVDLKFGYTPDQLIYEKVDFGVDLDSRIALVGPNGAGKSTLLKLMTGELEPLDGMVRRHNHLRIAQYHQHLAETLSLEMSALQYMMSEYPGLEEEKMRSAIGRFGLTGKAQVMPMGNLSDGQKSRVIFAWLAWRLPHLLLLDEPTNHLDIETIDSLAEALNEWDGGLVLVSHDFRLINQVAKEIWVCEKKTITRWNGDIMDFKRHLKRSAGL

SEQ ID NO: 6925 - protein, 597 aa, Ceratodon purpureus
MVSDASKKKAAAKKLAAAEKRGSKAAAVVAQTKLKDVTSGTTADTLAEELAAANITDRTCTGVLASHAQSRDIHIESLSVTFHGHELVADSTLELNYGRRYGLLGLNGCGKSTLLTAIGLREVPIPEHMDIYHLTREIDATDMTSLEAVMNVDEERLVLEKEAEKLAQQEDGGGEPLERIYERLEAMDSATAEMRAAQILHGLGFTKKMQNKKTRDFSGGWRMRIALARALFMNPTILLLDEPTNHLDLEACVWLEETLKKFERILVVVSHSQDFLNGVCTNIIHMQNKQLKFYSGNYDQYCQTRSELEENQMKQYRWEQEQISAMKEYIARFGHGSAKLARQAQSKEKTLAKMERGGLAEKVVRDKVLTFRFTDVGKLPPPVLQFVDLKFGYTPDQLIYEKVDFGVDLDSRIALVGPNGAGKSTLLKLMTGELEPLDGMVRRHNHLRIAQYHQHLAETLSLEMSALQYMMSEYPGLEEEKMRSAIGRFGLTGKAQVMPMGNLSDGQKSRVIFAWLAWRLPHMLLLDEPTNHLDIETIDSLAEALNEWDGGLVLVSHDFRLINQVAKEIWVCEKKTITRWNGDIMDFKRHLKKTAGL

SEQ ID NO: 6926 - protein, 597 aa, Physcomitrella patens
MVSDASKKKAAAKKLAAAEKRGSKSAAVVAQSKLKDVSNGTTADTLAEELAAANITDRTCTGILASHAQSRDIHIESLSVTFHGHELVADSTLELNYGRRYGLLGLNGCGKSTLLTAIGLREVPIPEHMDIYHLTREIDATDMTSLQAVMNVDSERLLLEKEAEKLSQQDDGGGEPLERIYERLEAMDSATAEMRAAQILHGLGFTKKMQNKKTRDFSGGWRMRIALARALFMNPTILLLDEPTNHLDLEACVWLEETLKKFERILVVVSHSQDFLNGVCTNIIHMQNKQLKFYTGNYDQYCQTRAELEENQMKQYRWEQEQISAMKEYIARFGHGSAKLARQAQSKEKTLAKMERGGLAEKVVRDKVLTFRFTDVGKLPPPVLQFVDLKFGYTPDQLIYEKVDFGVDLDSRIALVGPNGAGKSTLLKLMTGELEPLDGMVRRHNHLRIAQYHQHLAETLSLEMSALQYMMSEYPGLEEEKMRSAIGRFGLTGKAQVMPMGNLSDGQKSRVIFAWLAWRLPHLLLLDEPTNHLDIETIDSLAEALNEWDGGLVLVSHDFRLINQVAKEIWVCEKKTITRWNGDIMDFKRHLKKTAGL

SEQ ID NO: 6927 - protein, 541 aa, Trigonella foenum-graecum
MLYCIVLMFWFMLQLQIESLSVTFHGHDLIVDSELELNYGRRYGLLGLNGCGKSTLLTAIGCRELPIPDHMDIYHLSREIEASDMSALEAVISCDEERLRLEKEAEILGAQDDGGGEALERVYERLEAMDASTAEKRAAEILFGLGFNKEMQAKKTRDFSGGWRMRIALARALFMNPTILLLDEPTNHLDLEACVWLEENLKKFDRILVVISHSQDFLNGVCTNIIHMQNKKLKLYTGNYDQYVQTRAELEENQMKQYKWEQEQIASMKEYIARFGHGSAKLARQAQSKEKTLAKMERGGLTAKVVRDKILVFRFVDVGKLPPPVLQFVEVTFGYTPDNLIYKNIDFGVDLDSRIALVGPNGAGKSTFLKLMTGDLVPLDGMVRRHNHLRIAQFHQHLTEKLDLELSALQFMIKEYPGNEEERMRAAIGKFGLSGKAQVMPMRNLSDGQRSRVIFAWLAYRQPHLLLLDEPTNHLDIETIDSLAEALNEWDGGMVLVSHDFRLINQVAHEIWVCADQTVTRWEGDIMDFKQHLKAKAGLAD

SEQ ID NO: 6928 - protein, 516 aa, Musa acuminata
GHDLIVDSELELNYGRRYGLLGLNGCGKSTLLSAIGCRELPIPDHMDIYHLTREIEASDMSSLEAVISCDEERLKLEKEVEMLAGEDGGGGEALDRIYERLEALDASTAEKRAAEILYGLGFNKQMQAKKTRDFSGGWRMRIALARALFMNPTILLLDEPTNHLDLEACVWLEETLKKFDRILVVVSHSQDFLNGVCTNIIHMQNKKLKFYTGNYDQYVQTRSELEENQMKQYKWEQEQIASMKEYIARFGHGSAKLARQAQSKEKTLAKMERGGLTEKVVKDKVLVFRFTDVGKLPPPVLQFVGVTFGYTPDNLIYKNLDFGVDLDSRIALVGPNGAGKSTLLKLMTGDLAPLDGMVRRHNHLRIAQFHQHLAEKLDLEMPALQYMMKEYPGNEEEKMRAAIGKFGLSGKAQVMPMNNLSDGQRSRVIFAWLAWRQPHLLLLDEPTNHLDIETIDSLAEALNEWDGGLVLVSHDFRLINQVAEEIWVCENQAATRWEGDIMDFKQHLRSKTEFSD

SEQ ID NO: 6929 - protein, 533 aa, Lolium multiflorum
HEDPLSRDIHIESLSLTFHGHDLIVDSELELNYGRRYGLLGLNGCGKSTLLTAIGHRELPIPEHMDIHHLTREIEASDMSALQAVICCDEERIKLEKEAEILSAQDDGGGEALDLVYERLEAMDASTAEKRAAEILFGLGFDKKMQAKPTRDFSGGWRMRIALARALFMNPTILLLDEPTNHLDLEACVWLEEKLKNFERILVVISHSQDFLNGVCTNIIHMQNKILKLYTGNYDQYVQTRSELEENQMKQYKWEQEQIAGMKEYIARFGHGSAKLARQAQSKEKTLAKMERAGLAEKVVNDKILVFRFTDVGKLPPPVLQFADVTFGYTPDNLIYKNLDFGVDLDSRVALVGPNGAGKSTLLKLMTGDLTPLDGMVRRHNHLRIAQFHQHLTEKLDLDMPALQYMMKEYPGNEEEKMRAAIGKFGLSGKAQVMPMNNLSDGQKARVIFAWLAFRQPQMLLLDEPTNHLDIETIDSLAEALKEWDGGLVLVSHDFRLINQVAQEIWVCEKQAVTRWEGDIMDFKQHLKKRAGL

SEQ ID NO: 6930 - protein, 374 aa, Sorghum bicolor
MLGVARRRLGSGCVLSQLAQALRPAAAAPARTYSAAAKEITVREALNTALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSAEVLDSSFCLPIGKAKIERQGKDVTITAFSKMVGYALQAADILAKEGISAEVINLRSIRPLDRAAINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 6931 - protein, 375 aa, Saccharum officinarum
MLGVARRRLGSGCVLSQLAQALRPTAASAPARTYSAAAKEITVREALNTALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSAEVLDSSFCLPIGKAKIERQGKDVTITAFSKMVGYALQAADILAKEGISAEVINLRSIRPLDRAAINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 6932 - protein, 371 aa, Panicum virgatum
MLGVARRRLGSGCVLGQLAQALRPAAAARSYSVAAKEITVREALNSALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSDEVLDSSFCLPIGKAKIERQGKDVTITAFSKMVGYALQAADILAKEGISAEVINLRSIRPLDRAAINASVRKTNRLVTVEEGFPQHGIGAEICMAVVEDSFEYLDAPVERIAGADVPMPYAANLERMAVPQVEDIVRAAKRACYRAVPMAATA

SEQ ID NO: 6933 - protein, 374 aa, Oryza sativa
MLGIARRRLGSGCALGQLMQALRPAAAAAAARTYSAAAKEMTVREALNSALDEEMSADPSVFLMGEEVGEYQGAYKISKGLLDKYGPDRVLDTPITEAGFTGIGVGAAYQGLRPVVEFMTFNFSMQAIDHIINSAAKSNYMSAGQINVPIVFRGPNGAAAGVGAQHSQCYAAWYAHVPGLKVLTPYSAEDARGLLKAAIRDPDPVVFLENELLYGESFPVSAEVLDSSFCLPIGKAKIEQEGKDVTITAFSKMVGYALQAAEILSKEGISAEVINLRSIRPLDRATINASVRKTNRLVTLEEGFPQHGVGAEICMSVVEDSFEYLDAPVERIAGADVPMPYAANLERMAVPQVEDIVRAAKRACYRAVPMAATA

SEQ ID NO: 6934 - protein, 375 aa, Saccharum officinarum
MLGAARRQLGSGPMLGQVLRRLRPAAAAAEVARGYSAAAKEMTVRDALNSALDEEMSADPSVFLMGEEVGEYQGAYKISKGLLDKYGPDRVLDTPITEAGFTGIGVGAAYHGLRPIIEFMTFNFSMQAIDHIINSAAKSNYMSAGQISVPIVFRGPNGAAAGVGAQHSQCYAAWYAHVPGLKVLTPYSSEDARGLLKAAIRDPDPVIFLENELLYGESFPVSAEVLDSSFCLPIGKAKIEREGKDVTITAFSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAAAA

SEQ ID NO: 6935 - protein, 373 aa, Pennisetum glaucum
MLGAARRQLGSGPMLGQVLRRLRPAATEAARGYSVAAKEMTVRDALNSALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLTPYSAEDARGLLKAAIRDPDPVIFLENELLYGESFPVSDEVLDSSFCLPIGKAKIEREGKDVTITTYSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAATA

SEQ ID NO: 6936 - protein, 374 aa, Panicum virgatum
MLGAARRQLGSGPMLVQVLRRLRPAAATEAARGYSAAAKEMTVRDALNSALDEEMSADPSVFLMGEEVGEYQGAYKISKGLLDKYGPDRVLDTPITEAGFTGIGVGAAYQGLRPIVEFMTFNFSMQAIDHIINSAAKSNYMSAGQISVPIVFRGPNGAAAGVGAQHSQCYAAWYAHVPGLKVLTPYSAEDARGLLKAAIRDPDPVIFLENELLYGESFPVSAEVLDSSFCLPIGKAKVEREGKDVTITTYSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAATA

SEQ ID NO: 6937 - protein, 349 aa, Setaria italica
AAAAPARTYSAAAKEITVREALNSALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPVSDEVLDSSFCLPIGKAKIERQGKDVTITAFSKMVGYALQAADILAKEGISAEVINLRSIRPLDRATINASVRKTNRLVTVEEGFPQHGIGAEICMSVVEDSFEYLDAPVERIAGADVPMPYAANLERMAVPQVDDIVRAAKRACYRVVPMAATA

SEQ ID NO: 6938 - protein, 375 aa, Sorghum bicolor
MLGAARRQLGSGPMLGQVLRRLRPAAAAAEVARGYSAAAKEMNVRDALNSALDEEMSADPSVFLMGEEVGEYQGAYKISKGLLDKYGPDRVLDTPITEAGFTGIGVGAAYHGLRPIIEFMTFNFSMQAIDHIINSAAKSNYMSAGQISVPIVFRGPNGAAAGVGAQHSQCYAAWYAHVPGLKVLTPYSSEDARGLLKAAIRDPDPVIFLENELLYGESFPVSAEVLDSSFCLPIGKAKIEREGKDVTITTYSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAAAA

SEQ ID NO: 6939 - protein, 374 aa, Zea mays
MLGAARRQLGSGPMLGQVLRRLRPAVAAEVARGYSAAAKEMTVRDALNSALDEEMSADPSVFLMGEEVGEYQGAYKISKGLLDRYGPDRVLDTPITEAGFTGIGVGAAYHGLRPIIEFMTFNFSMQAIDHIINSAAKSNYMSAGQISVPIVFRGPNGAAAGVGAQHSQCYAAWFAHVPGLKVLTPYSSEDARGLLKAAIRDPDPVIFLENELLYGESFPVSAEVLDSSFCLPIGKAKIEREGKDVTITAFSKMVGYALQAAEILSKEGISAEVINLRSIRPLDRAAINASVRKTNRLVTVEEGFPQHGIGAEICMSVVEESFAYLDAPVERIAGADVPMPYAANLERMAVPQVDDIVRAAKRACYRAVPMAAAA

SEQ ID NO: 6940 - protein, 376 aa, Oryza sativa
MLGAARRQLGSGPMLGQVLRRLRPATAAAADAARAYSAAAKEMTVREALNSALDEEMSADPSVFLMGEEVGEYQGAYKISKGLLDKYGPERVLDTPITEAGFTGIAVGAAYQGLRPVVEFMTFNFSMQAIDHIINSAAKSNYMSAGQISVPIVFRGPNGAAAGVGAQHSQCYAAWYAHVPGLKVLVPYSAEDARGLLKAAIRDPDPVVFLENELLYGESFPISAEVLDSSFALPIGKAKIEREGKDVTITAYSKMVGYALQAADILSKEGISAEVINLRSIRPLDRATINASVRKTNRLVTIEESFPQHGIGAEICMSVVEESFEYLDAPVERIAGADVPMPYAANLERMAVPQVDDIVRAAKRACYRAVPMAATA

SEQ ID NO: 6941 - protein, 369 aa, Hordeum vulgare
MLGAARRSGCVLGQLMQTLRPAATAARSYSATPKEMTVREALNSALDEEMSADPSVFLMGEEVGEYQGAYKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRSSSMAATA

SEQ ID NO: 6942 - protein, 373 aa, Brachypodium distachyon
MLGAARRQLGSGPMLGQVLRRLRPASADAARGYAAAGKEITVREALNTALDEEMSADPSVFLMGEEVGEYQGAYKITKGLLDKYGPDRVLDTPITEAGFTGIGVGAAYQGLRPVIEFMTFNFSMQAIDHIINSAAKSNYMSAGQINVPIVFRGPNGAAAGVGAQHSQCYAAWYAHVPGLKVLAPYSAEDARGLLKAAIRDPDPVVFLENELLYGESFPVSDEVLDSSFSLPIGKAKIERKGKDVTITAFSKMVGYALQAADILSKEGISAEVINLRSIRPLDRAAINASVRKTNRLVTLEEGFPQHGVGAEICMSVVEESFEYLDAPVERIAGADVPMPYAANLERLAVPQVEDIVRAARRACYRAVPLAATA

SEQ ID NO: 6943 - protein, 373 aa, Brachypodium distachyon
MLGAARRSGCVLGQLIQTLRPAAAAAGPAARSYSAAAKEMTVREALNSALDEEMSADPSVFLMGEEVGEYQGAYKITKGLLDKYGPDRVLDTPITEAGFTGIGVGAAYQGLRPVIEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKDEVLDSSFSVPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRAGTMAATA

SEQ ID NO: 6944 - protein, 369 aa, Triticum aestivum
MLGAARRSGCVLGQLMQTLRPAATAARSYSATPKEMTVREALNSALDEEMSADPSVFLMGEEVGEYQGAYKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRSSSMAANA

SEQ ID NO: 6945 - protein, 370 aa, Musa acuminata
MLGLARRKLGFGLLSATRVLPAGSVLPKKYSTAAKEITVREALNTALDEEMSADPKVFLMGEEVGEYQGAYKISKGLLEKYGPDRVLDTPITEAGFTGIGVGAAYYGLRPVVEFMTFNFSMQAIDHIINSAAKSNYMSAGQISVPIVFRGPNGAAAGVGAQHSQCYAAWYAHVPGLKVLSPYSSEDARGLLKAAIRDPDPVVFLENELLYGESFPVSAEVLDSSFCLPIGKAKIEREGKHVTVTAFSKMVGYALQAAEILSKEGISAEVINLRSIRPLDRATINASVRKTNRLVTVEEGFPQHGVGAEICMSVMEESFEYLDAPVERIAGADVPMPYAANLERMAVPQVDDIVRAAKRACYRSVSMAAAA

SEQ ID NO: 6946 - protein, 376 aa, Avena sativa
MLGAARRQLGSGPMLGQVLRRLRPAAAASTEATRGYSAGAKEITVRDALNSALDEEMSADPSVFLMGEEVGEYQGAYKITKGLLDKYGPDRVLDTPITEAGFTGIGVGAAYQGLRPVIEFMTFNFSMQAIDHIINSAAKSNYMSAGQINVPIVFRGPNGAAAGVGAQHSQCYAAWFAHVPGLKVLAPYSSEDARGLLKAAIRDPDPVVFLENELLYGESFPVSDEVLDSSFALPIGKAKIEREGKDVTITAFSKMVGYALQAAEILSKEGISAEVINLRSIRPLDRAAINASVRKTNRLVTLEEGFPQHGVGAEICMSVVEESFEYLDAPVERIAGADVPMPYAANLERLAVPQIEDIVRAARRACYRAVPMAATA

SEQ ID NO: 6947 - protein, 372 aa, Festuca arundinacea
  misc_feature (7)..(7): Xaa can be any naturally occurring amino acid
MLGAARXSGCVLGRLAQALRPAAATTGAARTYSSAAKEMNVREALNSALDEEMAADPSVFLMGEEVGEYQGAYKITKGLLDKYGPDRVLDTPITEAGFTGIGVGAAYQGLRPVVEFMTFNFSMQAIDHIINSAAKSNYMSAGQINVPIVFRGPNGAAAGVGAQHSQCYAAWYSHVPGLKVLTPYSAEDARGLLKAAIRDPDPVVFLENELLYGDSFPISAEVLDSSFTVPIGKAKIEREGKDITITAFSKMVGYALQAAEILSKEGISAEVINLRSIRPLDRAAINASVRKTNRLVTVEEGFPQHGVGAEICMSVVEDSFEYLDAPVERIAGADVPTPYAANLERLAFPQVEDIVRAAKRACYRSTSMAATA

SEQ ID NO: 6948 - protein, 370 aa, Avena sativa
MLGAARRSGCVLGQLMQTLRPAAAGAARSYSSAAKEMNVREALNSALDEEMAADPSVFLMGEEVGEYQGAYKITKGLLDKYGPDRVLDTPITEAGFTGIGVGAAYQGLRPVVEFMTFNFSMQAIDHIINSAAKSNYMSAGQMSVPIVFRGPNGAAAGVGAQHSQCFAAWYAHVPGLKVLTPYSAEDARGLLKAAIRDPDPVVFLENELLYGESFPISAEVLDSSFTVPIGKAKIEREGKDVTITAYSKMVGFALQAAEILSKEGISAEVINLRSIRPLDRAAINASVRKTNRLVTVEEGFPQHGVGAEICMSVVEESFEYLDAPVERIAGADVPTPYAANLERLAFPQVEDIVRAAKRACYRATSMSATA

SEQ ID NO: 6949 - protein, 376 aa, Hordeum vulgare
MLGAARRQLGSGHMLAQVLRRLRPTAAASTEAARGYSSAAKEITVRDALNSALDEEMSADPSVFLMGEEVGEYQGAYKITKGLLDKYGPDRVLDTPITEAGFTGIGVGAAYQGLRPVIEFMTFNFSMQAIDHIINSAAKSNYMSAGQINVPIVFRGPNGAAAGVGAQHSQCYAAWFAHVPGLKVLAPYSSEDARGLLKAAIRDPDPVVFLENELLYGESFPVSDEVLDSSFALPIGKAKIEREGKDVTITAFSKMVGYALQAAEILSKEGISAEVINLRSIRPLDRAAINASVRKTNRLVTLEEGFPQHGVGAEICMSVVEESFEYLDAPIERIAGADVPMPYAANLERLAVPQIEDIVRAARRACYRALPMAATA

SEQ ID NO: 6950 - protein, 376 aa, Triticum aestivum
MLGAARRQLGSGPMLGQVLRRLRPAAAASTEAARGYSSAAKEITVRDALNSALDEEMSADPSVFLMGEEVGEYQGAYKITKGLLDKYGPDRVLDTPITEAGFTGIGVGAAYQGLRPVIEFMTFNFSMQAIDHIINSAAKSNYMSAGQINVPIVFRGPNGAAAGVGAQHSQCYAAWFAHVPGLKVLAPYSSEDARGLLKAAIRDPDPVVFLENELLYGESFPVSDEVLDSSFALPIGKAKIEREGKDVTITAFSKMVGYALQAAEILSKEGISAEVINLRSIRPLDRAAINASVRKTNRLVTLEEGFPQHGVGAEICMSVVEESFEYLDAPIERIAGADVPMPYAANLERLAVPQIEDIVRAARRACYRALPMAATA

SEQ ID NO: 6951 - protein, 334 aa, Pennisetum glaucum
ITVREALNSALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLTPYSSEDARGLLKAAIRDPDPVVFLENELLYGESFPVSDEVLDSSFCLPIGKAKIERQGKDITITAFSKMVGYALQAADILAKEGISAEVINLRSIRPLDRATINASVRKTNRLLTVEEGFPQHGIGAEICMSVVEDSFEYLDAPVERIAGADVPMPYAANLERMAVPQVDDIVRAAKRACYRVVPMAATA

SEQ ID NO: 6952 - protein, 377 aa, Elaeis guineensis
  misc_feature (19)..(19): Xaa can be any naturally occurring amino acid
MWGIARRKIGLGTFPSPIXGQVLQRIRPMGSALPKSYSTAAKEMTVREALNSALDEEMSADPKVFLMGEEVGEYQGAYKISKGLLEKYGPERVLDTPITEAGFAGIGVGAAYYGLRPVIEFMTFNFSMQAIDHIINSAAKSNYMSAGQISVPIVFRGPNGAAAGVGAQHSQCYAAWYAHVPGLKVLSPYSSEDARGLLKAAIRDPDPVVFLENELLYGESFPVSAEALDSSFCLPIGKAKIEREGKHVSITAFSKMVGYALQAAEILSKEGIDAEVINLRSIRPLDRATINASVRKTNRLVTVEEGFPQHGVGAEICMSIIEDSFEYLDAPVERIAGADVPMPYAANLERMAVPQVDDIVRAAKRACYRSVPMAAAA

SEQ ID NO: 6953 - protein, 377 aa, Zingiber officinale
  misc_feature (173)..(174): Xaa can be any naturally occurring amino acid
  misc_feature (303)..(303): Xaa can be any naturally occurring amino acid
MLGIARRKVGLGLFRAPILQERLHRVLPAGSVLSKKYSTSAKEIQVREALNSALDEEMSADPKVFLMGEEVGEYQGAYKISKGLLEKYGPERVLDTPITEAGFAGIGVGAAYYGLRPIVEFMTFNFSMQAIDHIINSAAKSNYMSAGQISVPIVFRGPNGAAAGVGAQHSQCXXAWYAHVPGLKVLTPYSSEDARGLLKAAIRDPDPVVFLENELLYGESFPVSAEALDSSFCLPIGKAKIEREGKDVTITAFSKMVGYALQAADVLSTEGISAEVINLRSIRPLDRATINASVRKTNRLITXEEGFPQHGVGAEICMSVVEESFEYLDAPVERIAGADVPMPYAANLERMAVPQVDDIVRAAKRACYRAVPLAAAA

SEQ ID NO: 6954 - protein, 368 aa, Ricinus communis
MLGIIKQKALGKSLQRIRPAVASAWRAYSSAAKEMTVREALNSALDEEMSADPKVFLMGEEVGEYQGAYKITKGLLDKYGPERVLDTPITEAGFTGIGVGAAYHGLKPVVEFMTFNFSMQAIDHIINSAAKSTYMSAGQLSVPIVFRGPNGAAAGVGAQHSQCYASWYASCPGLKVLAPYSSEDARGLLKAAIRDPDPVVFLENELLYGESFPVSAEVLDSSFCTPIGKAKIEREGKDVTITAFSKMVGYALKAAELLAKEGISAEVINLRSIRPLDRPTINASVRKTNRLVTVEEGFPQHGVGAEICASVIEDSFGYLDAPVERIAGADVPMPYAANLERMAVPQVEDIVRAAKRACYRSVPTAATA

SEQ ID NO: 6955 - protein, 372 aa, Cucumis melo
MWGIVRQKVGAGASSIPALQRLRPAASAPRYYSSAAKEMTVRDALNSALDEEMSADPKVFLMGEEVGEYQGAYKITKGLLEKYGPERVLDTPITEAGFTGIGVGAAYHGLKPVVEFMTFNFSMQAIDHIINSAAKTNYMSAGQISVPIVFRGPNGAAAGVGAQHSQCYAAWYGSCPGLKVLAPYSSEDARGLLKAAIRDPDPVVFLENELLYGESFPVSAEVLDSSFTAPIGKAKIEREGKDVTITAFSKMVGYALKAAEVLSKEGISAEVINLRSIRPLDRATINASVRKTNRLVTVEEGFPQHGVGAEICTSVVEESFGYLDAPVERIAGADIPMPYAANLERMAVPQVEDIVRAAKRACYRAVPLAATG

SEQ ID NO: 6956 - protein, 376 aa, Eucalyptus grandis
MLGVVRRKVSGGSSPLTILGQTLPFLRAAAAPLRSYSSAFKEMTVRDALNSALDEEMSADPRVFLMGEEVGEYQGAYKISKGLLDKYGPDRVLDTPITEAGFTGIGVGAAYHGLKPVIEFMTFNFSMQAIDHIINSAAKSNYMSAGQLSVPIVFRGPNGAAAGVGAQHSHCYASWYASCPGLKVLTPYSSEDARGLLKAAIRDPDPVVFLENELLYGESFPVSAEVLDSSFSLPIGKAKIEKEGKDVTITAFSKMVGLALKAADILAKEGINAEVINLRSIRPLDRATINASVRKTNRLVTVEEGFPQHGVGAEICTSVIEESFGYLDAPVERISGADVPMPYAANLERMAVPQVEDIVRAAKRACYRSVPMAAAA

SEQ ID NO: 6957 - protein, 376 aa, Prunus persica
MLGILRQKVGAGSSSAMILGQSMQRIRPTTSALRAFSSSAKEMTVRDALNSALDEEMSADPKVFLMGEEVGEYQGAYKISKGLLDKYGPDRVLDTPITEAGFTGIGVGAAYYGLKPVVEFMTFNFSMQAIDHIINSAAKSNYMSAGQINVPIVFRGPNGAAAGVGAQHSQCYAAWYAAVPGLKVLSPYSSEDARGLLKAAIRDPDPVVFLENELLYGESFPVSAEVLDSSFCLPIGKAKIEKEGKDVTITAFSKMVGYALQAAEILAKEGISAEVINLRSIRPLDRNTINASVRKTNRLVTVEEGFPQHGVGAEICTSVVEDSFGYLDAPVERIAGADVPMPYAANLERLAVPQVEDIVRAAKRACYRSASLAASA

SEQ ID NO: 6958 - protein, 373 aa, Populus trichocarpa
MFGIVRQKISAGGSPLLAFGQRIRPAVSAWRGYSSAAKEITVREALNSALDEEMSADPKVFLMGEEVGEYQGAYKISKGLLDKYGPERVLDTPITEAGFTGIGVGAAYHGLKPVIEFMTFNFSMQAIDHIINSAAKSNYMSSGQISVPIVFRGPNGAAAGVGAQHSHCYASWYASCPGLKVLAPYSSEDARGLLKAAIRDPDPVVFLENELLYGETFPVSAEVLDSSFCVPIGKAKIEREGKDVTITAFSKMVGYALKAAEILAKEGINAEVINLRSIRPLDRDTINASVRKTNRLVTVEEGFPQHGVGAEICASVVEESFGYLDAPVERIAGADVPMPYAANLERLAVPQVEDIVRAAKRACYRSVPMAAAA

SEQ ID NO: 6959 - protein, 367 aa, Euphorbia peplus
MLGIVRQKVLGQSLQKIRPAAAAWRNFSSASKEMTVREALNSALDEEMSADPKVFLMGEEVGEYQGAYKITKGLLDKYGPERVLDTPITEAGFTGIGVGAAYHGLKPVVEFMTFNFSMQAIDHIINSAAKSCYMSAGQLSVPIVFRGPNGAAAGVGAQHSQCYAAWYAACPGLKVLAPYSAEDARGLLKAAIRDPDPVVFLENELLYGESFPISDEVLDSSFCVPIGKAKIEREGKDVTITAFSKMVGYALKAAEILAKEGISAEVINLRSIRPLDRPAINASVRKTNRLVTVEEGFPQHGVGAEICASIVEESFGYLDAPVERIAGADVPMPYAANLERLAVPQVEDIVRAAKRACYRSTQMAAAA

SEQ ID NO: 6960 - protein, 367 aa, Tripterygium wilfordii
MWGVVSQKVLAQSLQRLRPAASAWRGFASGTKEINVREALNSALDEEMSADPKVFLMGEEVGEYQGAYKISKGLLEKYGPERVLDTPITEAGFTGIGVGAAYYGLKPIVEFMTFNFSMQAIDHIINSAAKSNYMSAGQMSVPIVFRGPNGAAAGVGAQHSHCYAAWYASCPGLKVLSPYSSEDARGLLKAAIRDPDPVVFLENELLYGESFPVSDEVLDSSFCIPIGKAKIEREGKDVTITAFSKMVGYALKAAETLEKEGISAEVINLRSIRPLDRATINSSVRKTGRLVTVEEGFPQHGVGAEICTSVVEDSFGYLDAPVERITGADVPMPYAANLERMAVPQVEDIVRAAKRACYRSVPMAATA

SEQ ID NO: 6961 - protein, 369 aa, Quercus alba
MLGIIRQKVGAGGASLLRTRSAVSALRSYSSAGKEMMVRDALNSALDEEMSADPKVFLMGEEVGEYQGAYKISKGLLDKYGPDRVLDTPITEAGFTGIGVGAAYHGLRPVVEFMTFNFSMQAIDHIINSAAKSNYMSAGQISVPIVFRGPNGAAAGVGAQHSHCYASWYASCPGLKVLTPYSSEDARGLLKAAIRDPDPVIFLENELLYGESFPVSAEVLDSSFCLPIGKAKIEREGKDVTITAFSKMVGYALKAAEILAKEGISAEVINLRTIRPLDRSTINASVRKTNRLITVEEGFPQHGVGAEICTSVVEESFGYLDAPVERITGADVPMPYAANLERLAVPQVEDIVRAAKRACYRSVPMAAAA

SEQ ID NO: 6962 - protein, 372 aa, Cucumis sativus
MWGIVRQKVGAGASSIPALQSLRPAASASRYYSSAAKEMTVRDALNSALDEEMSVDPKVFLMGEEVGEYQGAYKITKGLLEKYGPERVLDTPITEAGFTGIGVGAAYHGLKPVVEFMTFNFSMQAIDHIINSAAKTNYMSAGQISVPIVFRGPNGAAAGVGAQHSQCYAAWYGSCPGLKVLAPYSSEDARGLLKAAIRDPDPVVFLENELLYGESFPVSAEVLDSSFTAPIGKAKIEREGKDVTITAFSKMVGYALKAAEVLSKEGISAEVINLRSIRPLDRATINASVRKTSRLVTVEEGFPQHGVGAEICTSVVEESFGYLDAPVERIAGADIPMPYAANLERMAVPQVEDIVRAAKRACYRAVPLAATG

SEQ ID NO: 6963 - protein, 376 aa, Fragaria vesca
MLGILRQKLGAASSSATMLGQLQRIRPAVSALRGFSSSAKEQMTVRDALNSALDEEMSADPKVFIMGEEVGEYQGAYKITKGLLDKYGPDRVLDTPITEAGFTGIGVGAAYYGLKPVIEFMTFNFSMQAIDHIINSAAKSNYMSAGQINVPIVFRGPNGAAAGVGAQHSQCYAAWFGAVPGLKVLAPYSSEDARGLLKAAIRDPDPVVFLENELLYGESFPISAEVLDSSFCLPIGKAKIEREGKDITITAFSKMVGYALQAAEILAKEGISAEVINLRSIRPLDRATINASVRKTNRLLTVEEGFPQHGVGAEICASVVEESFGYLDAPVERIAGADVPMPYAANLERLAVPQVEDIVRAAKRACYRAVPLAANA

SEQ ID NO: 6964 - protein, 376 aa, Cucurbita pepo
MWGIVRKKVGAGASCILTSGQALQRLRPAASASRYYSSAAKEMTVRDALNSALDEEMSADPKVFLMGEEVGEYQGAYKITKGLLEKYGPERVLDTPITEAGFTGIGVGAAYHGLKPVVEFMTFNFSMQAIDHIINSAAKTNYMSAGQISVPIVFRGPNGAAAGVGAQHSQCYAAWYGACPGLKVLAPYSSEDARGLLKAAIRDPDPVVFLENELLYGESFPVSAEVLDSSFTAPIGKAKIEREGKDVTITAFSKMVGYALKAAEVLSKEGISAEVINLRSIRPLDRATINASVRKTNRLVTVEEGFPQHGVGAEICTSVVEESFGYLDAPVERIAGADIPMPYAANLERMAVPQVEDIIRAAKRACYRAVPLAASG

SEQ ID NO: 6965 - protein, 376 aa, Momordica charantia
MWGIIRQKVGAGGSSILISGQSLQRLRPAASASRYYSSAAKEMTVRDALNSALDEEMSADPKVFLMGEEVGEYQGAYKITKGLLDKYGPERVLDTPITEAGFTGIGVGAAYHGLKPVVEFMTFNFSMQAIDHIINSAAKTNYMSAGQISVPIVFRGPNGAAAGVGAQHSQCYAAWYGSCPGLKVLAPYSSEDARGLLKAAIRDPDPVVFLENELLYGESFPVSAEVLDSSFTAPIGKAKIEREGKDVTITAFSRMVGYALKAAEILSKEGISAEVINLRSIRPLDRATINASVRKTSRLVTVEEGFPQHGVGAEICTSVVEESFGYLDAPVERIAGADIPMPYAANLERMAVPQVEDIVRAAKRACYRAVPLAATG

SEQ ID NO: 6966 - protein, 367 aa, Amsonia hubrichtii
MAGALRKIVGCQGIPVSGIRVIASRAYSASAKEMTVRDALNSALDEEMSADSRVFLMGEEVGEYQGAYKISKGLLEKYGPDRVVDTPITEAGFTGIGVGAAYKGLKPVIEFMTFNFSMQAIDHIINSAAKSNYMSAGQISVPIVFRGPNGAAAGVGAQHSQCYAAWYGSVPGLKVLAPYSAEDARGLLKAAIRDPDPVVFLENELMYGESFPVSAEALDSSFVLPIGKAKVEREGKDVTITAFSKMVGYALQAADILAKEGFSAEVINLRSIRPLDRATINASVRKTNRLVTVEEGFPQHGVGAEICASVVEESFEYLDAPVERIAGADVPMPYAANLERVAVPQVEDIVRAAKRTCYRSVPLAAAA

SEQ ID NO: 6967 - protein, 373 aa, Malus domestica
MLGILRQKVGAGSSSAMILGQRIRPAASALRGFASSAKEMTVRDALNSALDEEMSADPKVFLMGEEVGEYQGAYKITKGLLDKYGPDRVLDTPITEAGFTGIGVGAAYYGLRPVIEFMTFNFSMQAIDHIINSAAKSNYMSAGQINVPIVFRGPNGAAAGVGAQHSQCYAAWYAACPGLKVLTPYSSEDARGLLKAAIRDPDPVVFLENELLYGESFPVSAEVLDSSFCLPIGKAKIEREGKDVTITAFSKMVGYSLQAAEILAKEGISAEVINLRSIRPLDRKTINDSVRKTNRLVTVEEGFPQHGVGAEICASVVEDSFGYLDAPVERISGADVPMPYAANLERLAVPQVEDIVRAAKRACYKSSSLAASA

SEQ ID NO: 6968 - protein, 367 aa, Manihot esculenta
MLGIIRQKAFGMSLQTIRPAASVWRGYSSAAKEMTVRDALNSALDEEMSADPKVFLMGEEVGEYQGAYKITKGLLEKYGPERVLDTPITEAGFTGIGVGAAYYGLKPVVEFMTINFSLQAIDHIINSAAKSNYMSAGRISVPIVFRGPNGAAAGVGAQHSQCYASWYASCPGLKVLAPYSSEDARGLLKAAIRDPDPVVFLENELLYGESFPVSAEVLDSSFCLPIGKAKIEREGKDVTITAFSKMVGYALKAAEILAKEGIIAEVINLRSIRPLDKHTINASVRKTNRLVTVEEGFPQHGIGAEICASIIEESFSYLDAPVERIAGADVPMPYAANLERMAVPQVEDIVRAAKRACYRSAPMAAAQ

SEQ ID NO: 6969 - protein, 376 aa, Platanus occidentalis
MFGIVRHKMGRGSFNASILGQSLQRIRPAVATSRSYSTASKEMTVRDALNSALDEEMSADPKVFLMGEEVGEYQGAYKISKGLLEKYGPERVRDTPITEAGFAGIGVGAAYYGLRPVVEFMTFNFSMQAIDHIINSAAKSNYMSAGQISVPIVFRGPNGAAAGVGAQHSQCYAAWYSSCPGLKVLTPYSSEDTRGLLKAAIRDPDPVVFLENELLYGESFPVSAEVLDSSFCLPIGKAKIEREGKDVTITAFSRMVGYSLQAAEILAKEGISAEVINLRSIRPLDRPTINASVRKTNRLVTVEEGFPQHGVGAEICTSVIEESFGYLDAPVERIAGADVPMPYAANLERMAVPQVDDIVRAAKRACYRSVSMAAAA

SEQ ID NO: 6970 - protein, 371 aa, Olea europaea
MLGVIRQRVACRGIPTRNFERGIRVVASRSLSSTAKEMTVREALNSALDEEMSADPKVFLMGEEVGEYQGAYKISKGLLEKYGPDRVVDTPITEAGFTGIGVGAAYYGLKPVIEFMTFNFSMQAIDHIINSAAKSNYMSAGQISVPIVFRGPNGAAAGVGAQHSQCYAAWYASCPGLKVLAPYSSEDARGLLKAAIRDPDPVVFLENELLYGESFPVSAETLDSSFCLPIGKAKIEREGKDVTITAFSKMVGYALQAAEILTKEGISAEVINLRSIRPLDRSTINASVRKTNRLVTVEEGFPQHGIGAEICASVLEDSFEYLDAPVERIAGADVPMPYAANLERISVPQVEDIVRAAKRSCYKSSSLAATA

SEQ ID NO: 6971 - protein, 378 aa, Actinidia deliciosa
MLGIVRRRIAREGVNASIVEQSLQKIRNQSLIYASRSYSSASKEMTVRDALNSALDEEMSADPKVFVMGEEVGEYQGAYKITKGLLDKYGPERVVDTPITEAGFAGIGVGAAYHGLRPVVEFMTFNFSMQAIDHIINSAAKSNYMSAGQISVPIVFRGPNGAAAGVGAQHSQCYAAWFGACPGLKVLAPYSSEDARGLLKAAIRDPDPVVFLENELLYGESFPVSAEVLDSSFCLPIGKAKIEREGKDVTITAFSKMVGYALKAAEILAKEGISAEVINLRSIRPLDRSTINASVRKTNRLVTVEEGFPQHGVGAEICASVVEESFEYLDAPVERIAGADVPMPYAANLERMAVPQIEDIVRAAKRACYRSVPLAATA

SEQ ID NO: 6972 - protein, 376 aa, Platanus occidentalis
MIGIVRQKIGCGGFRTSILGQSLKWIRPTESASRSYSSAAKEMTVRDALNSALDEEMSADPKVFLMGEEVGEYQGAYKISKGLLEKYGPERVLDTPITEAGFAGIGVGAAYYGLRPVVEFMTFNFSMQAIDHIINSAAKSNYMSAGQISVPIVFRGPNGAAAGVGAQHSQCYAAWYSSCPGLKVLAPYSSEDARGLLKAAIRDPDPVVFLENELLYGESFPVSAEVLDSSFCLPIGKAKIEREGKDVTITAFSKMVGYALQAAEILAKEGISAEVINLRSIRPLDRPTINTSVRKTNKLVTVEEGFPQHGVGAEICTSIVEESFGYLDAPVERIAGADVPMPYAANLERMAVPQVEDIVRAVRRACYRSVPMAASA

SEQ ID NO: 6973 - protein, 370 aa, Citrus clementina
MWGIIRQKVAAGGGSPVARIRPVVSNLRNYSSAVKQMMVREALNSALDEEMSADPKVFLMGEEVGEYQGAYKISKGLLEKYGPERVLDTPITEAGFTGIGVGAAYYGLKPVVEFMTFNFSMQAIDHIINSAAKSNYMSSGQISVPIVFRGPNGAAAGVGAQHSQCYAAWYASVPGLKVLSPYSSEDARGLLKAAIRDPDPVVFLENELLYGESFPVSAEVLDSSFCLPIGKAKIEREGKDVTITAFSKIVGLSLKAAEILAKEGISAEVINLRSIRPLDRSTINASVRKTNRLVTVEEGFPQHGVGAEICASVIEESFGYLDAPVERIAGADVPMPYAANLERMAVPQVEDIVRAAKRACYRSVPMAAAA

SEQ ID NO: 6974 - protein, 367 aa, Gossypium hirsutum
MLGIVRQKMLGQSLLKIRPAISVLRSYSSAAKQMTVREALNSALDEEMSADPKVFLMGEEVGEYQGAYKISKGLLEKYGPERVLDTPITEAGFAGIGVGAAYYGLKPVVEFMTFNFSMQAIDHIINSAAKSNYMSAGQMSVPIVFRGPNGAAAGVGAQHSQCYASWYASCPGLKVLSPYSSEDARGLLKAAIRDPDPVVFLENELLYGESFPVSDEVLDSSFCLPVGKAKIERKGKDVTITAFSKMVGYALKAAEILEKEGIDAEVINLRSIRPLDRSTINASVRKTNRLITVEEGFPQHGVGAEICASVVEESFAYLDAPVERIAGADVPMPYAANLERMAVPQVEDIVRAAKRACYRAVPLAAAA

SEQ ID NO: 6975 - protein, 367 aa, Euonymus alatus
MWGVISQKVLAKSLQPLRPGASAWRGFASGTKEITVREALNSALDEEMSADPKVFLMGEEVGEYQGAYKISKGLLDKYGPERVLDTPITEAGFTGIGVGAAYYGLKPVVEFMTFNFSMQAIDHIINSAAKSNYMSAGQISVPIVFRGPNGAAAGVGAQHSHCYAAWYASCPGLKVLSPYSSEDARGLLKAAIRDPDPVVFLENELLYGESFPVSDEVFDSSFCIPIGEAKIEREGKDVTITAFSKMVGYALKAAETLEKEGISAEVINLRSIRPLDRATINSSVRKTSRLVTVEEGFAQHGVGAEICTSVVEDSFGYLDAPVERISGADVCMPYAANLERMAVPQVDDIVRAAKRACHRSVPMAATA

SEQ ID NO: 6976 - protein, 356 aa, Tripterygium wilfordii
QSLQHLRPAASAWRGFASATKEMNVRDALNSALDEEMSADPKVFLMGEEVGEYQGAYKITKGLLDKYGPERVLDTPITEAGFTGIGVGAAYYGLKPIVEFMTFNFSMQAIDHIINSAAKSNYMSAGQISVPIVFRGPNGAAAGVGAQHSQCYAAWYASCPGLKVLSPYSSEDARGLLKAAIRDPDPVVFLENELLYGESFPVSDEVLDSSFCLPIGKAKIEREGKDVTITAFSKMVGYALKAAETLEKEGISAEVINLRSIRPLDRATINSSVRKTNRLVTVEEGFPQHGVGAEICTSVVEDSFAYLDAPVERISGVDVPMPYAANLERMAVPQVEDIVRAAKRACYRSVPMAATA

SEQ ID NO: 6977 - protein, 370 aa, Citrus sinensis
MWGIIRQKVAAGGGSPVARIRPVVSNLRNYSSAVKQMMVREALNSALDEEMSADPKVFLMGEEVGEYQGAYKISKGLLEKYGPERVLDTPITEAGFTGIGVGAAYYGLKPVVEFMTFNFSMQAIDHIINSAAKSNYMSSGQISVPIVFRGPNGAAAGVGAQHSQCYAAWYASVPGLKVLSPYSSEDARGLLKAAIRDPDPVVFLENELLYGESFPVSAEVLDSSFCLPIGKAKIEREGKDVTITAFSKIVGLSLKAAEILAKEGISAEVINLRSIRPLDRSTINASVRKTNRLVTVEEGFPQHGVGAEICASVIEESFSYLDAPVERIAGADVPMPYAANLERMAVPQVEDIVRAAKRACYRSVPMAAAA

SEQ ID NO: 6978 - protein, 358 aa, Populus trichocarpa
MLGIIRQKAFGQRIRPAVSAWRGYSSAAKEMTVREALNSALDEEMSADPKVFLMGEEVGEYQGAYKISKGLLDKYGPERVLDTPITEAGFTGIGVGAAYHGLKPVIEFMTFNFSMQAIDHIINSAAKSNYMSAGQISVPIVFRGPNGAAAGVGAQHSHCYAAWYASCPGLKVLAPYSSEDARGLLKAAIRDPDPVVFLENELLYGETFPVSAEVLDSSFCLPIGKAKIEKEGKDVTITAFSKMVGYALKAAEILAKEGISAEVINLRSIRPLDRNTINASVRKTNRLVTVEEGFPQHGVGAEICASVVEESFGYLDAPVERIAGADVPMPYAANLERLAVPQVEDIVRAAKRACYRSV

SEQ ID NO: 6979 - protein, 367 aa, Gossypium hirsutum
MLGIVRQKMLGQSLLKIRPAISVLRSYSSAAKQMTVREALNSALDEEMSADPKVFLMGEEVGEYQGAYKISKGLLEKYGPERVLDTPITEAGFAGIGVGAAYYGLKPVVEFMTFNFSMQAIDHIINSAAKSNYMSAGQMSVPIVFRGPNGAAAGVGAQHSQCYASWYASCPGLKVLSPYSSEDARGLLKAAIRDPDPVVFLENELLYGESFPVSDEVLDSSFCLPIGKAKIERKGKDVTITAFSKMVGYALKAAEILEKEGIDAEVINLRSIRPLDRSTINASVRKTNRLITVEEGFPQHGVGAEICASVVEESFAYLDAPVERIAGADVPMPYAANLERMAVPQVEDIVRAAKRACYRVVPLAAAA

SEQ ID NO: 6980 - protein, 362 aa, Phaseolus coccineus
  misc_feature (167)..(167): Xaa can be any naturally occurring amino acid
MWGVIRQKTQSIRPAFSAIRHFSSAAKEITVREALNTALDEEMSADPKVFLMGEEVGEYQGAYKISKGLLDKYGPDRVLDTPITEAGFAGIGVGAAYYGLRPVVEFMTFNFSMQAIDHIINSAAKSNYMSAGQISVPIVFRGPNGAAAGVGAQHSQCYASWYASCPXLKVLTPYSSEDARGLLKAAIRDPDPVVFLENELLYGESFPVSAEVLDSSFCLPIGKAKIEREGKDVTITAYSKMVGFALKAAEILAKEGISAEVINLRSIRPLDRSTINTSVRKTNRLVTVEEGFPQHGVGAEICTSVIEESFGYLDAPVERIAGADVPMPYAANLERMAVPQIEDIVRAAKRACHRSVPLAAAA

SEQ ID NO: 6981 - protein, 373 aa, Chelidonium majus
MLGVLRQKVGCRCNPASILGQSMPKTWSATRSFSSAAKQMTVRDALNSALDEEMSADPKVFLMGEEVGEYQGAYKITKGLLDKYGPERVRDTPITEAGFTGIGVGAAYYGLRPVVEFMTFNFSMQAIDHIINSAAKSNYMSAGQINVPIVFRGPNGAAAGVGAQHSQCYAAWYGSCPGLKVLAPYSAEDARGLLKAAIRDPDPVVFLENELLYGESFPVSEEVLDSSYCLPIGKAKIEREGKDITITAFSKMVGFALQAAEILSKEGISAEVINLRSIRPLDRQTINASVRKTNRLVTVEEGYPQHGVGAEICASVVEESFAYLDAPVERIAGADVPMPYAANLERMAVPQVEDIVRAAKRICYRSVPVAANA

SEQ ID NO: 6982 - protein, 370 aa, Citrus sinensis
MWGIIRQKVAAGGGSPVARIRPVVSNLRNYSSAVKQMMVREALNSALDEEMSADPKVFLMGEEVGEYQGAYKISKGLLEKYGPERVLDTPITEAGFTGIGVGAAYYGLKPVVEFMTFNFSMQAIDHIINSAAKSNYMSSGQISVPIVFRGPNGAAAGVGAQHSHCYAAWYASVPGLKVLSPYSSEDARGLLKAAIRDPDPVVFLENELLYGESFPVSAEVLDSSFCLPIGKAKIEREGKDVTITAFSKIVGLSLKAAEILAKEGISAEVINLRSIRPLDRSTINASVRKTNRLVTVEEGFPQHGVGAEICASVIEESFGYLDAPVERIAGADVPMPYAANLERMAVPQVEDIVRAAKRACYRSVPMAAAA

SEQ ID NO: 6983 - protein, 373 aa, Malus domestica
MLGILRQKVGAGSSSAMILGQRIRPATSAMRGLASSAKEMTVRDALNSALDEEMSADPKVFLMGEEVGEYQGAYKITKGLLDKYGPDRVRDTPITEAGFTGIGVGAAYYGLKPVIEFMTFNFSMQAIDHIINSAAKSNYMSAGQINVPIVFRGPNGAAAGVGAQHSQCYAAWYATCPGLKVLTPYSSEDARGLLKAAIRDPDPVVFLENEILYGESFPISAEVLDSSFCLPIGKAKIEREGKDVTITAFSKMVGYSLQAAEILAKEGIRAEVINLRSIRPLDRKTINDSVRKTNRLVTVEEGFPQHGVGAEICASVVEDSFGYLDAPVERIAGADVPMPYAANLERLAVPQVEDIVRAAKRACYRASSLAASA

SEQ ID NO: 6984 - protein, 325 aa, Primula obconica
MLGFVKQTIANGGFNSSKIRSRSFLNAVRGYASAGKEMTVRDALNSALDEEMSADPKVFVMGEEVGEYQGAYKITKGLLDKYGPDRVIDTPITEAGFTGIGVGAAYHGLRPVIEFMTFNFSMQAIDHIINSAAKSNYMSAGQINVPIVFRGPNGAAAGVGAQHSQCYAAWYGSVPGLKVLAPYSAEDARGLLKAAIRDPDPVVFLENELLYGESFPVSQEVLDSSFCLPIGKAKIEREGKDVTITAFSKMVGYALKAAEILAKEGISAEVINLRSIRPLDRSTINASVRKTNRLVTLEEGYLNMVLVLRFVHLLLRRVLSILMLL

SEQ ID NO: 6985 - protein, 299 aa, Fragaria vesca
  misc_feature (270)..(270): Xaa can be any naturally occurring amino acid
MLGILRQKLGAASSSATMLGQLQRIRPAVSALRGFSSSAKEQMTVRDALNSALDEEMSADPKVFIMGEEVGEYQGAYKITKGLLDKYGPDRVLDTPITEAGFTGIGVGAAYYGLKPVIEFMTFNFSMQAIDHIINSAAKSNYMSAGQINVPIVFRGPNGAAAGVGAQHSQCYAAWFGAVPGLKVLAPYSSEDARGLLKAAIRDPDPVVFLENELLYGESFPISAEVLDSSFCLPIGKAKIEREGKDITITAFSKMVGYALQAAEILAKEXISAEVINLRSIRPLDRATINASVRKPTDF

SEQ ID NO: 6986 - protein, 369 aa, Tropaeolum majus
MLGGIARQKMLGLSVQKIRPAGYAFRNFSSAGKEMTVREALNSALDEEMSADPKVFLMGEEVGEYQGAYKITKGLLDKYGPERVLDTPITEAGFTGIGVGAAYYGLKPVVEFMTFNFSMQAIDHIINSAAKSNYMSAGQINVPIVFRGPNGAAAGVGAQHSHCYAAWYGSCPGLKVLTPYSSEDARGLLKAAIRDPDPVVFLENELLYGESFPVSAEVLDSSYSTPIGKAKIEREGKDVTITAFSKMVGFSLKAAEILAKEGISAEVINLRSIRPLDRATINASVRKTNRLVTVEEGFPQHGVGAEICTSVIEESFGYLDAPVERIAGADVPMPYAANLERLAVPQVEDIVRAAKRACYRSSVPMAAAA

SEQ ID NO: 6987 - protein, 367 aa, Euphorbia esula
  misc_feature (205)..(205): Xaa can be any naturally occurring amino acid
  misc_feature (225)..(225): Xaa can be any naturally occurring amino acid
  misc_feature (362)..(362): Xaa can be any naturally occurring amino acid
MLGIIRQKAFGQSLQKIRPAAAAWRSFSSASKEMTVREALNSALDEEMSADPKVFLMGEEVGEYQGAYKITKGLLDKYGPERVLDTPITEAGFTGIGVGAAYHGLKPVVEFMTFNFSMQAIDHIINSAAKSCYMSSGQLSVPIVFRGPNGAAAGVGAQHSQCYAAWYAACPGLKVLAPYSAEDARGLLKAAIRDPDPVVFLENEXLYGESFPISDEVLDSSFCVXIGKAKIEREGKDVTITAFSKMVGYALKAAEILAKEGISAEVINLRSIRPLDRPAINASVRKTNRLVTVEEGFPQHGVGAEICASIVEESFGYLDAPVERIAGADVPMPYAPILRDWQCPRLRILCVQQRGLAIDLHXWLQLL

SEQ ID NO: 6988 - protein, 362 aa, Vigna unguiculata
MWGVIKHKTQSIRPAFSAIRHFSSAAKEITVREALNTALDEEMSADPKVFLMGEEVGEYQGAYKISKGLLEKYGPERVLDTPITEAGFAGIGVGAAYYGLRPVVEFMTFNFSMQAIDHIINSAAKSNYMSAGQISVPIVFRGPNGAAAGVGAQHSQCYASWYATCPGLKVLTPYSSEDARGLLKAAIRDPDPVVFLENELLYGESFPVSAEALDSSFCLPIGKAKIEREGKDVTITAYSKMVGYALKAAEALAKEGISAEVINLRSIRPLDRATINTSVRKTNRLVTVEEGFPQHGVGAEICTSVIEESFGYLDAPVERIAGADVPMPYAANLERMAVPQIEDIVRAAKRACHRSVPLAAAA

SEQ ID NO: 6989 - protein, 360 aa, Arachis hypogaea
MLRAIRHKNILPAFSAFRAFSSSAKEMTVREALNSALDEEMSADPKVFLMGEEVGEYQGAYKITKGLLDKYGPERVLDTPITEAGFTGIGVGAAYYGLRPVVEFMTFNFSMQAIDHIINSAAKSNYMSAGQISVPIVFRGPNGAAAGVGAQHSQCYAAWYASCPGLKVLSPYSSEDARGLLKAAIRDPDPVVFLENELLYGESFPVSAEVLDSSFCLPIGKAKIEREGKDVTITAFSKMVGYALKAAEILAKEGISAEVINLRSIRPLDRSTINASVRKTNRLVTVEEGFPQHGVGAEICTSVIEESFGYLDAPVERIAGADVPMPYAANLERMAVPQVEDIVRAAKRACYRSVPLAATA

SEQ ID NO: 6990 - protein, 367 aa, Vitis vinifera
MLGIVSRKVLGQSLGRIRPAVSALRNYSSAEKQMTVRDALNSALDEEMSADPKVFLMGEEVGEYQGAYKISKGLLEKYGPERVLDTPITEAGFTGIGVGAAYYGLKPVVEFMTFNFSMQAIDHIINSAAKSNYMSAGQISVPIVFRGPNGAAAGVGAQHSQCYAAWYGSCPGLKVLSPYSSEDARGLLKAAIRDPDPVIFLENELLYGESFPISAEVLDSSFCLPIGKAKIEREGRDVTITAFSKMVGFALKAADILAKDGISAEIINLRSIRPLDTPTINASVRKTNRLVTVEEGFPQHGVGAEICMAVVEESFGYLDAPVERIAGADVPMPYAANLERMAVPQIEDIVRAAKRACYRSTAMAATA

SEQ ID NO: 6991 - protein, 367 aa, Theobroma cacao
MLGIVRQKVLGQSLQKVRPGVSLLRSYSSAAKQMTVREALNSALDEEMSADPKVFLMGEEVGEYQGAYKISKGLLEKYGPERVLDTPITEAGFTGIGVGAAYYGLKPVVEFMTFNFSMQAIDHIINSAAKSNYMSAGQISVPIVFRGPNGAAAGVGAQHSQCYAAWYASCPGLKVLTPYNSEDARGLLKAAIRDPDPVIFLENELLYGESFPVSDEVLDSSFCLPIGKAKIEREGKDVTISAFSKMVGHALKAAEILEKDGIDAEVINLRSIRPLDRSTINTSVRKTNRLITVEEGFPQHGVGAEICASVVEESFGYLDAPVERVAGADVPMPYAANLERMAVPQVEDIVRAAKRACYRSVPLAAAA

SEQ ID NO: 6992 - protein, 371 aa, Lippia dulcis
MFGLLRRKVTCKGNPASGLEQGIRVLAARAFSSSAKEMTVRDALNSALDEEMSADPKVFLMGEEVGEYQGAYKISKGLLDKYGPERVLDTPITEAGFAGIGVGAAYYGLKPVIEFMTFNFSMQAIDHIINSAAKSNYMSAGQMSVPIVFRGPNGAAAGVGAQHSQCYAAWYGSCPGLKVLTPYSSEDARGLLKAAIRDPDPVVFLENELLYGESFPVSDEVLDSSFCLPIGKAKIEREGRDVTITAFSKMVGYALQAAEILAKDGISAEVINLRSIRPLDGATINASVRKTNRLVTLEEGFPQHGVGAEICASVLEESFEYLDAAVERIAGADVPMPYAANLERMAVPQVDDIVRAAKRTCYRSSSVAATA

SEQ ID NO: 6993 - protein, 367 aa, Tabernaemontana elegans
MAGALRKMLGCRGIPVLGIRVIASRTYSSSVKEMTVRDALNSALDEEMSADSSVFLMGEEVGEYQGAYKISKGLLEKYGPDRVIDTPITEAGFAGIGVGAAYKGLKPVIEFMTINFSLQAIDHIINSAAKSNYMSAGQISVPIVFRGPNGAAAGVGAQHSQCYAAWYSSVPGLKVLAPYSAEDARGLLKAAIRDPDPVVFLENELMYGESFPISAEALDSSFCLPIGKAKVEREGKDVTITAFSKMVGYALKAAEILAKDGISAEVINLRSIRPLDRATINGSVRKTNRLVTVEEGFPQHGVGAEICASIVEESFEYLDAPVERIAGADVPMPYAANLERMAVPQVEDIVRAAKRTCYRSVPVAAAA

SEQ ID NO: 6994 - protein, 369 aa, Tropaeolum majus
MLGGIARQKMLGLSVRKIRPAVYAFRNFSSAGKEMTVREALNSALDEEMSADPKVFLMGEEVGEYQGAYKITKGLLDKYGPERVLDTPITEAGFTGIGVGAAYYGLKPVVEFMTFNFSMQAIDHIINSAAKSNYMSAGQINVPIVFRGPNGAAAGVGAQHSHCYAAWYGSCPGLKVLTPYSSEDARGLLKAAIRDPDPVVFLENELLYGESFPVSAEVLDSSYSTPIGKAKIEREGKDVTITAFSKMVGFSLKAAEILAKEGISAEVINLRSIRPLDRATINASVRKTNRLVTVEEGFPQHGVGAEICTSVIEESFGYLDAPVERIAGADVPMPYAANLERLAVPQVEDIVRAAKRACYRSSVPMAAAA

SEQ ID NO: 6995 - protein, 360 aa, Glycine max
MLGVIRHKSIRPAFSAIRHLSSAAKEITVREALNSALDEEMSADPKVFLMGEEVGEYQGAYKISKGLLDKYGPERVLDTPITEAGFTGIGVGAAYYGLRPVVEFMTFNFSMQAIDHIINSAAKSNYMSAGQISVPIVFRGPNGAAAGVGAQHSQCYASWYGSCPGLKVLSPYSSEDARGLLKAAIRDPDPVVFLENELLYGESFPVSAEVLDSSFCLPIGKAKIEREGKDVTITAYSKMVGFALKAAETLAKEGISAEVINLRSIRPLDRSTINTSVRKTNRLVTVEEGFPQHGVGAEICTSVIEESFGYLDAPVERIAGADVPMPYAANLERMAVPQVEDIVRAAKRACYRSVPLAASA

SEQ ID NO: 6996 - protein, 372 aa, Lippia dulcis
MLGVLRRKVACQGAHAWGLEQGLRVIASRALSSSAKETMTVRDALNSALDEEMSADPKVFVMGEEVGEYQGAYKITKGLLNKYGPERVLDTPITEAGFAGIGVGAAYYGLKPVIEFMTFNFSMQAIDHIINSAAKSNYMSSGQISVPIVFRGPNGAAAGVGAQHSQCYAAWFGACPGLKVLTPYSSEDARGLLKAAIRDPDPVVFLENELLYGESFPVSAEVLDSSFCLPIGKAKIEREGKDVTITAFSKMVGYALQAADILAKEGFSAEVINLRSICPLDRAAINASVRKTNRLVTVEEGFPQHGVGAEICASVLEDSFEYLDAAVERISGADVPMPYAANLERMAVPQVEDIVRAAKRTCYRSTALAATA

SEQ ID NO: 6997 - protein, 373 aa, Centaurea maculosa
  misc_feature (219)..(219): Xaa can be any naturally occurring amino acid
MRGIISQKLGGLSSQVVGNYMLRLRPAASARHYSSATKEMTVRDALNSALDEEMAADPNVFVMGEEVGEYQGAYKITKGLLDKYGPERVVDTPITEAGFAGIGVGSAYHGLRPVIEFMTFNFSMQAIDHIINSAAKSNYMSAGQINVPIVFRGPNGPAAGVGAQHSQCYGAWYGSVPGLKVLVPYSSEDARGLLKAAIRDPDPVVFLENELLYGESFPXSAEALDSSFCLPIGKAKIEREGKDITITAFSKMVGYALKAAEILEKEGINAEVINLRSIRPLDRATINASVRKTNRLVTVEEGFPQHGVGAEICASVVEDSFGYLDAPVERIAGADVPTPYAANLERMAFPQIEDIVRAAKRACYRSVPMAATA

SEQ ID NO: 6998 - protein, 367 aa, Catharanthus roseus
MAGALRKIVGFRGTPISGIRVIASRAYSSSVKEMTVRDALNSALDEEMSADSRVFLMGEEVGEYQGAYKISKGLLEKYGPERVIDTPITEAGFTGIGVGAAYKGLKPVIEFMTFNFSMQAIDHIINSAAKSNYMSAGQISVPIVFRGPNGAAAGVGAQHSQCYAAWYAAVPGLKVLTPYTAEDARGLLKAAIRDPDPVVFLENELLYGESFPVSAEALDSSFCLPIGKAKVEREGKDVTITAFSKMVGYSLKAAEILAKEGISAEVINLRSIRPLDRATINTSVRKTNRLVTVEEGFPQHGVGAEICAAVVEESFEYLDAPVERISGADVPMPYAANLERMAVPQVEDIVRAAKRACYRSVPLAAAA

SEQ ID NO: 6999 - protein, 371 aa, Orobanche aegyptiaca
MLGIIRQKVAARANPAKGLEQGVRVIASRMFSSSAKEMTVRDALNSALDEEMSADPKVFLMGEEVGEYQGAYKISKGLLEKYGPERVVDTPITEAGFTGIGVGAAYYGLRPVIEFMTFNFSMQAIDHIINSAAKSNYMSAGQISVPIVFRGPNGAAAGVGAQHSQCYAAWYGSCPGLKVLAPYSSEDARGLLKAAIRDPDPVVFLENELLYGESFPISAEALDSSFCLPIGKAKIEREGKDVTITAFSKMVGYALQAAEILAKDGIRAEVINLRSIRPLDRATINASVRKTNKLVTVEEGFPQHGVGAEICASVLEDSFEYLDAAVERISGADVPMPYAANLERMAVPQVEDIVRAAKRTCYRSSSLDATA

SEQ ID NO: 7000 - protein, 365 aa, Triphysaria pusilla
MLGLIRQRAAFKANPASNLEQGIRAMAMRAFSSSAKEMTVRDALNSALDEEMSADPKVFLMGEEVGEYQGAYKISKGLLDKYGPERVCDTPITEAGFTGIGVGAAYYGLRPVIEFMTFNFSMQAIDHIINSAAKSNYMSAGQISVPIVFRGPNGAAAGVGAQHSQCYAAWFGACPGLKVLAPYSSEDARGLLKAAIRDPDPVVFLENELLYGESFPVSAEVLDSSFCLPIGKAKIEREGNDVTITAFSKMVGYSLQAAEILAKEGISAEVVNLRSIRPLDRATINASVRKTNRLVTVEEGFPQHGVGAEICATVVEDSFGYLDAPVERIAGADVPMPYAANLERLAVPQVEDIVRAAKRACYRSR

SEQ ID NO: 7001 - protein, 367 aa, Nicotiana tabacum
  misc_feature (128)..(128): Xaa can be any naturally occurring amino acid
  misc_feature (136)..(136): Xaa can be any naturally occurring amino acid
  misc_feature (362)..(362): Xaa can be any naturally occurring amino acid
MSGIIGRTMASRKISALNQFLMGSRVFASRTYSSSAKEMTVRDALNSALDEEMSADPKVFVMGEEVGEYQGAYKITKGLLDKYGPERVLDTPITEAGFAGIGVGAAYHGLKPIIEFMTFNFSMQAIDXIINSAAKXNYMSAGQISVPIVFRGPNGAAAGVGAQHSQCYAAWFGSCPGLKVLAPYSSEDARGLLKAAIRDPDPVVFLENELLYGESFPVSAEALDSSFCLPIGKAKIEREGKDVTITAFSKMVGYALQAAEILAKEGISAEVINLRSIRPLDRPAINASVRKTNRLVTVEEGFPQHGVGAEICASVVEESFEYLDAPVERISGADVPMPYAANLERMAVPQVEDIVRAAKRAXYRAAK

SEQ ID NO: 7002 - protein, 360 aa, Lotus japonicus
MWGVTRLKTIRPAFSSLRQFSSVAKEMTVREALNSALDEEMSADPKVFLMGEEVGEYQGAYKITKGLLEKYGPERVLDTPITEAGFTGIGVGAAYYGLRPVVEFMTFNFSMQAIDHIINSAAKSNYMSAGQINVPIVFRGPNGAAAGVGAQHSQCYASWYGSCPGLKVLSPYSSEDARGLLKAAIRDPDPVVFLENELLYGESFPVSAEVLDSSFCLPIGKAKIEREGKDVTITAFSKMVGYALKAAEILAKEGISAEVINLRSIRPLDRSTINTSVRKTNRLVTVEEGFPQHGVGAEICTSVIEESFGYLDAPVERIAGADVPMPYAANLERMAVPQVEDIVRAAKRACYRSVPLAAAA

SEQ ID NO: 7003 - protein, 361 aa, Medicago truncatula
MLGVIRNKNLLRPSFSAFRHLSSSAKQMTVRDALNSALDEEMSADPKVFLMGEEVGEYQGAYKISKGLLEKYGPERVLDTPITEAGFTGIGVGAAYYGLKPVVEFMTFNFSMQAIDHIINSAAKSNYMSAGQINVPIVFRGPNGAAAGVGAQHSHCYASWYGSCPGLKVLAPYSSEDARGLLKAAIRDPDPVVFLENELLYGESFPVSAEVLDSSFCLPIGKAKIEREGKDVTITAFSKMVGFALKAAETLEKEGISAEVINLRSIRPLDRATINASVRKTNRLVTVEEGFPQHGVGAEICASVIEESFGYLDAPVERIAGADVPMPYAANLERLAVPQIEDIVRAAKRACHRSVPMAATA

SEQ ID NO: 7004 - protein, 360 aa, Glycine max
MLGVIRHKSIRPAFSAIRHFSSAAKEITVRDALNSALDEEMSADPKVFLMGEEVGEYQGAYKISKGLLDKYGPERVLDTPITEAGFAGIGVGAAYYGLRPVVEFMTFNFSMQAIDHIINSAAKSNYMSAGQISVPIVFRGPNGAAAGVGAQHSQCYASLYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINASVRKTNRLVTVEEGFPQHGVGAEICTSVIEESFGYLDAPVERIAGADVPMPYAANLERMAVPQVEDIVRAAKRACYRSVPLAASA

SEQ ID NO: 7005 - protein, 360 aa, Glycine max
MLGVIRHKSIRPAFSAIRHFSSAAKEMTVREALNSALDEEMSADPKVFLMGEEVGEYQGAYKISKGLLDKYGPERVLDTPITEAGFAGIGVGAAYYGLRPVVEFMTFNFSMQAIDHIINSAAKSNYMSAGQISVPIVFRGPNGAAAGVGAQHSQCYASLYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINASVRKTNRLVTVEEGFPQHGVGAEICTSVIEESFGYLDAPVERIAGADVPMPYAANLERMAVPQVEDIVRAAKRACYRSVPLAASA

SEQ ID NO: 7006 - protein, 365 aa, Triphysaria pusilla
MLGLIRQRAACKGNQASSLEQGIRAMALRAFSSSAKEMTVRDALNSALDEEMSADPKVFIMGEEVGEYQGAYKISKGLLDKFGPERVRDTPITEAGFAGIGVGAAYYGLRPVVEFMTFNFSMQAIDHIINSAAKSNYMSAGQISVPIVFRGPNGAAAGVGAQHSQCYAAWFGACPGLKVLTPYSSEDARGLLKAAIRDPDPVVFLENELLYGESFPVSAEVLDSSFCLPIGKAKIEREGKDVTITAYSKMVGYSLQAAEILAKEGISAEVINLRSIRPLDRATINASVRKTSRLVTVEEGFPQHGVGAEICATVVEDSFEYLDAPVERIAGADVPMPYAANLERLAVPQVEDIVRAAKRACYRSR

SEQ ID NO: 7007 - protein, 373 aa, Antirrhinum majus
  misc_feature (23)..(23): Xaa can be any naturally occurring amino acid
  misc_feature (369)..(369): Xaa can be any naturally occurring amino acid
MLGVIRQRVACKGNPASSLEQRXRVVASRAFSSSAKEMTVRDALNSALDEEMAADPKVFIMGEEVGEYQGAYKISKGLLDKYGPDRVVDTPITEAGFTGIGVGAAYYGLRPVIEFMTFNFSMQAIDHIINSAAKSNYMSAGQISVPIVFRGPNGAAAGVGAQHSQCYASWYGSCPGLKVLTPYSSEDARGLLKAAIRDPDPVVFLENELLYGESFPLSAEALDSSFSLPIGKAKIEREGKDVTITAFSKMVGYSLQAAEILAKEGISAEVINLRSIRPLDRSTINASVRKTNRLVTVEEGFPQHGVGAEICASVVEESFEYLDAPVERIAGADVPTPYAANLERLAFPQVEDIVRAAKRACYRSSSASXAANA

SEQ ID NO: 7008 - protein, 260 aa, Scabiosa columbaria
MWGIMRQKAVPNVQNIRPMFSALRTYSSAAKEMTVRDALNSALDEEMSADPKVFVMGEEVGEYQGAYKITKGLLDKYGPDRVVDTPITEAGFTGIGVGAAYYGLRPVIEFMTFNFSMQAIDHIINSAAKSNYMSAGQINVPIVFRGPNGAAAGVGAQHSQCYAAWFGACPGLKVLAPYSSEDARGLLKAAIRDPDPVVFLENELLYGESFPVSEEVLDSSFCVPIGKAKIEKEGKDVTIATFSKWWGMLSRLLRYLPKRE

SEQ ID NO: 7009 - protein, 363 aa, Mimulus guttatus
MLGIIRQRAASKVSHASSLEQGIRTLRAFSSSAKQMTVRDALNSALDEEMSADPKVFVMGEEVGEYQGAYKITKGLLDKYGPERVIDTPITEAGFAGIGVGAAYYGLRPVIEFMTFNFSMQAIDHIINSAAKSNYMSAGQISVPIVFRGPNGAAAGVGAQHSQCYAAWYASCPGLKVLAPYSSEDARGLLKAAIRDPDPVVFLENELLYGESFPVSAEVLDSSFCLPIGKAKIEREGKDVTITAFSKMVGYALQAAEILAKEGISAEVINLRSIRPLDRSTINTSVRKTNRLVTLEEGFPQHGVGAEICATVVEDSFEYLDAPVERISGADVPMPYAANLERMAVPQVEDIVRAAKRACYRSS

SEQ ID NO: 7010 - protein, 367 aa, Vinca minor
MAGALRKIVSCRGIPVSGIRVIASRAYSSSMKEMTVRDALNSALDEEMSADSSVFVMGEEVGEYQGAYKISKGLLEKYGPDRVIDTPITEAGFAGIGVGAAYKGLRPVIEFMTFNFSMQAIDHIINSAAKSNYMSAGQISVPIVFRGPNGAAAGVGAQHSQCYASWFGSVPGLKVLAPYSSEDARGLLKAAIRDPDPVVFLENELLYGESFPVSSEVIDSSFCLPIGKAKVEREGTDVTITAFSKMVGYSLKAAEILAKEGISAEVINLRSIRPLDRATINASVRKTNRLVTVEEGFSQHGVGAEICASVVEDSFEHLDAPVERITGADVPMPYAANLERMAVPQIEDIVRAAKRACYRSVPLAAAA

SEQ ID NO: 7011 - protein, 367 aa, Amsonia hubrichtii
MAGALRKIVDCRGIPVSGVRVIASRAYSSLVKEMTVRDALNSALDEEMSADSRVFLMGEEVGEYQGAYKISKGLLEKYGPDRVIDTPITEAGFAGIGVGAAYKGLKPVIEFMTYNFSLQAIDHIINSAAKSNYMSAGQISVPIVFRGPNGAAAGVGAQHSQCYAAWYGSVPGLKVLAPYSAEDARGLLKAAIRDPDPVVFLENELMYGESFPVSAEALDSSFVVPIGKAKVEREGKDVTITAFSKMVGYALQAAEILAKEGISAEVINLRSIRPLDRATINASIRKTNRLVTVEEGFPQHGVGAEICASVVEESFEYLDAPVERIAGADVPMPYAANLERMAVPQVEDIVRAVKRTCYRSVPLAAAA

SEQ ID NO: 7012 - protein, 377 aa, Unknown
  Sequence found in Organisms: Solanum tuberosum, Solanum phureja
MSGIINRKMATRGISALNMNQFLLGSRVFASRNFSSATKEMTVRDALNSALDEEMSADPKVFIMGEEVGEYQGAYKITKGLLNKYGPQRVLDTPITEAGFTGMGVGAAYHGLKPVIEFMTFNFSMQAIDHIINSAAKSNYMSAGQISVPIVFRGPNGAAAGVGAQHSQCYAAWFGACPGLKVLAPYSSEDARGLLKAAIRDPDPVVFLENELLYGESFPVSAEVLDSSFSLPIGKAKIEREGKDITITAFSKMVGYALKAAEILAKEGISAEVINLRSIRPLDRSTINASVRKTNRLLTVEEGFPQHGVGAEICASVVEESFEYLDAPVERISGADVPMPYAANLERMAVPQIEDIVRGAKRACYRAAKSVPMAATA

SEQ ID NO: 7013 - protein, 376 aa, Tragopogon dubius
MWGIVRREIGAKGLSALVSRNYVQSLRPAAASMRHYSSASKEMTVRDALNSALDEEMAADPNVFIMGEEVGEYQGAYKISKGLLDKYGPERVVDTPITEAGFAGIGVGSAYHGLKPVIEFMTFNFSMQAIDHIINSAAKSNYMSAGQINVPIVFRGPNGPAAGVGAQHSQCYGAWYGSVPGLKVLVPYSSEDARGLLKAAIRDPDPVVFLENELLYGESFPISDEALDSSFCLPIGKAKIEREGKDITITAFSKMVGYALKAAEILEKDGISAEVINLRSIRPLDRATINASVRKTNRLVTVEEGFPQHGIGAEICASVVEDSFAYLDAPVERIAGADVPTPYAANLERHAFPQIEDIVRAVKRVCYRSVPMAATA

SEQ ID NO: 7014 - protein, 360 aa, Glycine max
MLGVIRHKSIRHAFSAIRHLSSAAKEITVREALNSALDEEMSADPKVFLMGEEVGEYQGAYKISKGLLEKFGPERVLDTPITEAGFAGIGVGAAYYGLRPVVEFMTFNFSMQAIDHIINSAAKSNYMSAGQISVPIVFRGPNGAAAGVGAQHSQCYASWYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINTSVRKTNRLVTVEEGFPQHGVGAEICTSVIEESFGYLDAPVERIAGADVPMPYAANLERMAVPQVEDIVRAAKRTCYRSVPLAASA

SEQ ID NO: 7015 - protein, 373 aa, Helianthus annuus
MLGIVRRNVGGAGGLYSQGFGRLRPVASAIRNYSSGGKEMTVRDALNSALDEEMAADPNVFVMGEEVGEYQGAYKITKGLLDKYGPERVLDTPITEAGFAGIGVGSAYHGLKPVIEFMTFNFSMQAIDHVINSAAKSNYMSAGQINVPIVFRGPNGPAAGVGAQHSQCYGAWYGSVPGLKVLVPYSSEDARGLLKAAIRDPDPVVFLENELLYGESFPVSAEALDSSFCLPIGKAKIEREGKDITITAFSKMVGYALKAAEILEKDGINAEVINLRSIRPLDRATINASVRKTNRLVTVEEGFPQHGIGAEICASVIEDSFGYLDAPVERVAGADVPTPYAANLERMAFPQIEDIVRAAKRACYRSVPMAASA

SEQ ID NO: 7016 - protein, 367 aa, Tropaeolum majus
MFGALRHKMLGQSLAKLRPAVSSLRCYSSAGKEMTVRDALNSAIDEEMSADPKVFLMGEEVGEYQGAYKITKGLLEKYGPERVLDTPITEAGFTGIGVGAAYYGLKPVVEFMTINFSLQAIDHIINSAAKSNYMSSGQINVPIVFRGPNGAAAGVGAQHSHCYASWYASCPGLKVLAPYSSEDARGLLKAAIRDPDPVVFLENELLYGESFPVSAEVLDSSFCVPIGKAKIEREGKDVTLVAFSKMVGFCLKAAEILSKEGISAEVVNLRSIRPLDRATINASVRKTNRLVTVEEGFPQHGIGAEICTSVVEESFGYLDAPVERIAGADVPMPYAANLERLAVPQIEDIVRAAKRACYRSAPMSATA

SEQ ID NO: 7017 - protein, 376 aa, Lactuca sativa
MWGLIRQEVGARGLSALVSGSYVQSLRPVAATRRHYSSATKEMTVRDALNSALDEEMAADPNVFIMGEEVGEYQGAYKISKGLLDKYGPERVVDTPITEAGFAGIGVGSAYHGLRPVIEFMTFNFSMQAIDHIINSAAKSNYMSAGQINVPIVFRGPNGPAAGVGAQHSQCYGAWYGSVPGLKVLVPYSSEDARGLLKAAIRDPDPVVFLENELLYGESFPISAEALDSSFCLPIGKAKIEREGTDITITAFSKMVGYALKAAEILEKEGISAEIINLRSIRPLDRATINASVRKTNRLVTVEEGFPQHGVGAEICASVVEDSFAYLDAPVERIAGADVPTPYAANLERSAFPQIEDIVRAAKRVCYRSVPMAATA

SEQ ID NO: 7018 - protein, 360 aa, Manihot esculenta
MLRIIRQKRILPAASSLRGYSSASKQMMVREALNSALDEEMSADPKVFLMGEEVGEYQGAYKISKGLLEKYGPERVLDTPITEAGFTGIGVGAAYYGLKPVVEFMTFNFSMQAIDHIINSAAKSCYMSAGQISVPIVFRGPNGAAAGVGAQHSQCYASWYASCPGLKVLAPYSSEDARGLLKAAIRDPDPVVFLENELLYGESFPVSAEVLDSSFCLPIGKAKIEREGKDVTITAFSKMVGYALKAAEILAKDGISAEIINLRSIRPLDRPAINASVRKTSRLVTVEEGFPQHGVGAEICASIIEESFGYLDAPVERIAGADVPMPYAANLERMAVPQVEDIVRAAKRACYRSKPMAAAQ

SEQ ID NO: 7019 - protein, 374 aa, Ipomoea nil
MSGIVGRKMASTGISALIANRFLMRSRVFASRSFSSTTKEITVRDALNSALDEEMSADPKVFLMGEEVGEYQGAYKITKGLLEKYGPDRVLDTPITEAGFAGIGVGAAYYGLKPIIEFMTFNFSMQAIDHIINSAAKSNYMSAGQISVPIVFRGPNGAAAGVGAQHSQCYAAWYAACPGLKVLAPYSSEDARGLLKAAIRDPDPVVFLENELLYGESFPISDEALDSSFCLPIGKAKIEREGKDVTITAFSKMVGYALKAAEILAKEGISAEVINLRSIRPLDRSTINASVRKTNRLVTVEEVFPQHGVGAEICATVVEESFGYLDAPVERISGADVPMPYAANLERMALPQVEDIVRAAKRTCYRSVQKAAAA

SEQ ID NO: 7020 - protein, 366 aa, Capsicum annuum
MAGIIGRTMATAKISNLNKFLVGSRVSASRTYSSAAKEMTVRDALNSALDEEMSADPKVFVMGEEVGEYQGAYKITKGLLDKYGPERVLDTPITEAGFTGIGVGAAYYGLKPIIEFMTFNFSMQAIDHIINSAAKSNYMSAGQISVPIVFRGPNGAAAGVGAQHSQCYAAWYGACPGLKVLAPYSSEDARGLLKAAIRDPDPVVFLENELLYGESFPVSAEALDSSFSLPIGKAKIEREGKDVTITAFSKMVGYALKAAEILDKEGISAEVINLRSIRPLDRPAINASVRKTNRLVTVEEGFPQHGVGAEICASVVEESFEYLDAPVERITGADVPMPYAANLERLAVPQIEDIVRAAKRACYRSK

SEQ ID NO: 7021 - protein, 366 aa, Lippia dulcis
MLGIISRRGVCKGSHASSSEQGIRSIALRAFSSSAKEQMTVRDALNSALDEEMSADDKVFLMGEEVGEYQGAYKITKGLLDKYGPKRVVDTPITEAGFTGIGVGAAYHGLRPVVEFMTFNFSMQAIDHIINSAAKSNYMSAGQISVPIVFRGPNGAAAGVGAQHSQCYAAWYGSCPGLKVLAPYSSEDARGLLKAAIRDPDPVVFLENELLYGESFPISAEALDSSFCLPIGKAKIEREGKDVTIVAFSKMVGYSLQAAEILAKEGISAEVINLRSIRPLDRSTINTSVRKTNRIVTVEEAFPQHGVGAEICASVVEESFEYLDAPVERIAGADVPMPYAANLERLAVPQVEDIVRAAKRACYRSS

SEQ ID NO: 7022 - protein, 335 aa, Plantago ovata
MTVRDALNSALDEEMAADPKVFIMGEEVGEYQGAYKISKGLLAKYGPDRVVDTPITEAGFAGIGVGAAYYGLKPVIEFMTFNFSMQAIDHIINSAAKSNYMSAGQISVPIVFRGPNGAAAGVGAQHSQCYAAWFGACPGLKVLTPYSSEDARGLLKAAIRDPDPVVFLENELLYGESFPVSDEVLDSSFCLPIGKAKIERQGTDVTITAFSKMVGYALQAAEILAKEGISAEVINLRSIRPLDRSTINASVRKTNRLVTLEEGFPQHGVGAEICASVLEDSFEYLDAPVQRIAGADVPMPYAANLERLALPQVEDIVRAAKRTCYRSSAALAATA

SEQ ID NO: 7023 - protein, 199 aa, Guizotia abyssinica
TGGVSSQGLGSYMMRLRPVASAMRNYSSATKEMTVRDALNSALDEEMAADPNVFVMGEEVGEYQGAYKITKGLLDKYGPERVVDTPITEAGFTGIGVGAAYHGLRPVTEFMTFNFSMQAIDHIINSAAKSNYMSAGQINVPIVFRGPNGPAAGVGAQHSQCYGAWYGSVPGLKCLYLTHLKMLVDFLKLQLEILILVFS

SEQ ID NO: 7024 - protein, 378 aa, Abies balsamea
MWGALRQKSGLTTLVSSLRHGQVSERLVSMASTPLRQLSTAAKEMTVRDALNSAIDEEMSADPKVFLMGEEVGEYQGAYKISKGLLQKFGPDRVLDTPITEAGFTGIGVGAAYYGLRPIVEFMTFNFAMQAIDQIINSAAKTCYMSAGQISVPIVFRGPNGAAAGVGAQHSQCYAAWYASCPGLKVLTPYSAEDSRGLLKAAIRDPDPVVFLENELLYGESFPVSAECLDPSFCLPIGKAKIEREGRDVTITAFSKMVGYALQAAQELEKEGISAEVINLRSIRPLDRATINASVRKTSRLVTVEEGFPQHGIGAEICTSVIEESFEYLDAPVERIAGADVPMPYAANLERLAVPQVEDIIRASKRACYRAVPMSAVA

SEQ ID NO: 7025 - protein, 378 aa, Pinus pinaster
MWGALRQKSGMTTLFSSLRHGQVLERLVPMASTPLRNLSTAAKEISVRDALNSAIDEEMSADPKVFLMGEEVGEYQGAYKISKGLLQKFGPDRVLDTPITEAGFTGIAVGAAYYGLRPIVEFMTFNFAMQAIDQIINSAAKTYYMSAGQISVPIVFRGPNGAAAGVGAQHSQCYAAWYASCPGLKVLTPYSAEDSRGLMKAAIRDPDPVVFLENELLYGESFPVSAECLDPSFCLPIGKAKIEREGKDVTITAFSKMVGYALQAAQELEKEGISAEVINLRSIRPLDRATINASVRKTSRLVTVEEGFPQHGIGAEICASVVEESFEYLDAPVERITGADVPMPYAANLERLAVPQVEDIIRASKRACYRAVPMSAVA

SEQ ID NO: 7026 - protein, 378 aa, Pinus taeda
MWGALRQKSGMTTLFSSLRHGQVLERLVPMASTPLRNLSTAAKEITVRDALNSAIDEEMSADPKVFLMGEEVGEYQGAYKISKGLLQKFGPDRVLDTPITEAGFTGIAVGAAYYGLRPIVEFMTFNFAMQAIDQIINSAAKTYYMSAGQISVPIVFRGPNGAAAGVGAQHSQCYAAWYASCPGLKVLTPYSAEDSRGLMKAAIRDPDPVIFLENELLYGESFPVSAECLDPSFCLPIGKAKIEREGKDVTITAFSKMVGYALQAAQELEKEGISAEVINLRSIRPLDRATINASVRKTSRLVTVEEGFPQHGIGAEICASVVEESFEYLDAPVERITGADVPMPYAANLERLAVPQVEDIIRASKRACYRAVPMSAVA

SEQ ID NO: 7027 - protein, 378 aa, Pseudotsuga menziesii
MLGALRQKSGLTSLVSSLRHGQVLERLAPMASTPLRKLSTAAKEMTVRDALNSAIDEEMSADPKVFLMGEEVGEYQGAYKISKGLLQKFGPDRVLDTPITEAGFTGIGVGAAYYGLRPIVEFMTFNFAMQAIDQIINSAAKTYYMSAGQISVPIVFRGPNGAAAGVGAQHSQCYAAWYASCPGLKVLTPYSAEDSRGLLKAAIRDPDPVIFLENELLYGMSFPVSAECLDPSFCLPIGKAKIEREGKDVTITAFSKMVGYALQAAQELEKEGISAEVINLRSIRPLDRATINASVRKTSRLVTVEEGFPQHGIGAEICTSVVEESFEYLDAPVERITGADVPMPYAANLERLALPQVEDIIRASKRACYRAVPMSAVA

SEQ ID NO: 7028 - protein, 367 aa, Vinca minor
MAGALRKIVGCRGIPVSGIRVIGSRAYSSSGKEMTVRDALNSALDEEMSADSRVFVMGEEVGEYQGAYKISKGLLEKYGPDRVIDTPITEAGFAGIGVGAAYKGLKPVIEFMTFNFSMQAIDHIINSAAKSNYMSAGQISVPIVFRGPNGAAAGVGAQHSQCYAAWFGSVPGLKVLAPYSSEDARGLLKAAIRDPDPVVFLENELLYGESFPISSEALDSSFCLPIGKAKVELEGKDVTITAFSKMVGYALKAAEILAKEGISAEVINLRSIRPLDRATINASVRKTNRLVTVEEGFSQHGVGAEISASVVEDSFEYLDAPVERITGADVPMPYAANLERMAVPQIEDIVRAAKRACYRSVPLAAAA

SEQ ID NO: 7029 - protein, 377 aa, Solanum lycopersicum
MSGIINRKMATRGISALNMNQFLLGSRVFASRNFSSATKEMTVRDALNSALDEEMSADPKVFIMGEEVGEYQGAYKITKGLLNKYGPQRVLDTPITEAGFTGMGVGAAYHGLKPVIEFMTFNFSMQAIDHIINSAAKSNYMSAGQIAVPIVFRGPNGAAAGVGAQHSQCYAAWFGACPGLKVLAPYSSEDARGLLKAAIRDPDPVVFLENELLYGESFPVSAEVLDSSFALPIGKAKIEREGKDITITAFSKMVGSALKAAEILAKEGISAEVINLRSIRPLDRSTINASVRKTNRLLTVEEGFPQHGVGAEICASVVEESFEYLDAPVERISGADVPMPYAANLERMAVPQIEDIVRGAKRACYRAAKSVPMAATA

SEQ ID NO: 7030 - protein, 391 aa, Carthamus tinctorius
  misc_feature (314)..(314): Xaa can be any naturally occurring amino acid
  misc_feature (316)..(317): Xaa can be any naturally occurring amino acid
MRGIISQKLGGLSAQVVGNYMPRLRPAMPMRHYSSATKEMTVRDALNSALDEEMAADPNVFVMGEEVGEYQGAYKITKGLLDKYGPERVVDTPITEAGFAGIGVGSAYHGLRPVIEFMTFNFSMQAIDHIINSAAKSNYMSAGQINVPIVFRGPNGPAAGVGAQHSQCYGAWYGSVPGLKVLVPYSSEDARGLLKAAIRDPDPVVFLENELLYGESFPISAEALDSSFCLPIGKAKIEREGKDITITAFSKMVGYALKAAEILEKEGINAEVINLRSIRPLDRATINASVRKTNRLVTVEEGFPHMVLVQKSVXLXXKIALVILMLLWRGLLELMFRRLMLLILREWLFLRLRILYVLLREHATGRCLWLQLLENENADFSFSFVWGGWIF

SEQ ID NO: 7031 - protein, 360 aa, Trigonella foenum-graecum
MLGVIRNKSIRPSFSAFRFLSSSAKQMTVRDALNSALDEEMSADPKVFLMGEEVGEYQGAYKISKGLLEKYGPDRVLDTPITEAGFTGIGVGAAYYGLKPVVEFMTFNFSMQAIDHIINSAAKSNYMSAGQINVPIVFRGPNGAAAGVGAQHSHCYASWYGSCPGLKVLAPYSSEDARGLLKAAIRDPDPVVFLENELLYGESFPVSAEVLDSSFCLPIGKAKIEREGKDVTITAFSKMVGFALKAAEILAKEGINAEVINLRSIRPLDRSTINASVRKTNRLVTVEEGFPQHGVGAEICASVIEESFGYLDAPVERIAGADVPMPYAANLERLAVPQIEDIVRAAKRACHRSVPMAATA

SEQ ID NO: 7032 - protein, 380 aa, Sciadopitys verticillata
MLGVLRQKSATGLINLVSSLRHGQVPDRVVPMASTPLRNLSTAAKEMTVRDALNSALDEEMSADPKVFLMGEEVGEYQGAYKISKGLLQKFGPDRVIDTPITEAGFTGIGVGAAYYGLKPVVEFMTFNFAMQAMDHIINSAAKSYYMSAGQISVPIVFRGPNGAASGVGAQHSQCYAAWYGSCPGLKVLVPYSSEDARGLLKAAIRDPDPVIFLENELIYGESFPVSAECLDSSFCLPIGKAKIEKEGKDVTITAFSKMVGYALQAAKELAKEGISAEVINLRSIRPLDRDTINASVRKTNRLVTVEEGFPQHGVGAEICTSVIEESFEYLDAPVERIAGADVPMPYAANLERMAVPQVEDIIRAAKRACYREVPMSAAA

SEQ ID NO: 7033 - protein, 377 aa, Taraxacum officinale
MWGIIRQNVGGARDLSSQILRSSMPRLRPISSAVRHYSSATKEMTVRDALNSALDEEMAADPNVFVMGEEVGEYQGAYKITKGLLDKYGPERVVDTPITEAGFTGIGVGSAYHGLRPVIEFMTFNFSMQAIDHIINSAAKSNYMSAGQINVPIVFRGPNGPAAGVGAQHSQCYGAWYASVPGMKVLVPYSSEDARGLLKAAIRDPDPVVFLENELLYGESFPVSAEALDSSFCLPIGKAKIEREGTDITITAFSKMVGYALKAAEILEKEGISVEVINLRSIRPLDRATINASVRKTNRLVTVEEGFPQHGIGAEICASVVEDSFGYLDAPVERIAGADVPTPYAANLERMAFPQIEDIVRAVKRVCYRAVPLAATA

SEQ ID NO: 7034 - protein, 363 aa, Plantago ovata
MLGAIRQRVACKSSLASNGVGVLAARAFSSSGKETMTVRDALNSALDEEMSADPKVFIMGEEVGEYQGAYKITKGLLNKYGPDRVVDTPITEAGFAGIGVGAAYYGLRPVIEFMTFNFSMQAIDHIINSAAKSNYMSAGQISVPIVFRGPNGAAAGVGAQHSQCYAAWYGSCPGVKVLAPYSSEDARGLLKAAIRDPDPVVFLENELLYGESFPVSAEVLDSSFSLPIGKAKIEREGKDVTITAFSKMVGYALQAADILSKEGISAEVINLRSIRPLDRATINASVRKTNRLVTLEEGFPQHGVGAEICASVVEESFDCLDAPIERIAGADVPMPYAANLERLAVPQVDDVVRAAKRACYRSK

SEQ ID NO: 7035 - protein, 378 aa, Picea glauca
MWGALQQKSGLATLVSSLKHGQVLERLVPMAFTPSRKLSTAAKEMTVRDALNSAIDEEMSADPKVFLMGEEVGEYQGAYKISKGLLQKFGPDRVLDTPITEAGFTGIGVGAAYYGLRPIVEFMTFNFAMQAIDQIINSAAKTNYMSAGQISVPIVFRGPNGAAAGVGAQHSHCYAAWYGSCPGLKVLTPYSAEDSRGLLKAAIRDPDPVIFLENELLYGESFPVSAECLDPSFCLPIGKAKIEREGKDVTITAFSKMVGYALQAAQELEKEGISAEVINLRSIRPLDRATINASVRKTSRLVTVEEGFPQHGIGAEICASVVEESFEYLDAPVERITGADVPMPYAANLERLAVPQVEDIVHASKRACYRAVPMSAVV

SEQ ID NO: 7036 - protein, 378 aa, Picea glauca
MWGALRQKSGLTTLVSSLKHGQVLERFAPMASTPLRQLSTAAKEMTVRDALNSAIDEEMSADPKVFLMGEEVGEYQGAYKISKGLLQKFGPDRVLDTPITEAGFTGIGVGAAFYGLRPIVEFMTFNFAMQAIDQIINSAAKTYYMSAGQISVPIVFRGPNGAAAGVGAQHSQCYAAWYGSCPGLKVLTPYSAEDSRGLMKAAIRDPDPVIFLENELLYGESFPVSAECLDPSFCLPIGKAKIEREGKDVTITAFSKMVGYALQAAQELEKEGISAEVINLRSIRPLDRATINASVRKTSRLVTVEEGFPQHGIGAEICTSVVEESFEYLDAPVERITGADIPMPYAANLERLAVPQVEDIIRASKRACYRAVPMSAVA

SEQ ID NO: 7037 - protein, 368 aa, Artemisia annua
MLGVIRQKVIGAKDVMRLRPVVSSMRHYSSGTKEMTVRDALNSALDEEMAADPNVFVMGEEVGEYQGAYKITKGLLDKYGPERVVDTPITEAGFAGIGVGSAYHGLKPVIEFMTFNFSMQAIDHIINSAAKSNYMSAGQINVPIVFRGPNGPAAGVGAQHSQCYGAWYGSVPGLKVLVPYSSEDARGLLKAAIRDPDPVVFLENELLYGESFPISDEALDSSFCLPIGKAKIEREGKDITITAFSKMVGYALKAAEILEKDGISAEIINLRSIRPLDRATINASVRKTNRLVTVEEGFPQHGIGAEICASVVEDSFGYLDAPVERIAGADVPTPYAANLERMAFPQIEDIVRAAKRVCYRSVPLAATA

SEQ ID NO: 7038 - protein, 122 aa, Pinus taeda
MWGALRQKSGMTTLFSSLRHGQVLERLVPMASTPLRNLSTAAKEITVRDALNSAIDEEMSADPKVFLMGEEVGEYQGAYKISKGLLQKFGPDRVLDTPITEAGFTGIAVAQHTMGYDQLWSS

SEQ ID NO: 7039 - protein, 334 aa, Taraxacum officinale
MTVRDASNSALDEEMAADPSVFVMGEEVGEYQGAYKITKGLLDKYGPERVVDTPITEAGFAGIGVGSAYHGLRPVIEFMTFNFSMQAIDHIINSASKSNYMSAGQINVPIVFRGPNGPAAGVGAQHSQCYGAWYASVPGLKVLVPYSSEDARGLLKAAIRDPDPVVFLENELLYGESFPISAEALDSSFCLPIGKAKIEREGTDITITAFSKMVGYALKAAEILEKEGISVEVINLRSIRPLDRATINASVRKTNRLVTVEEGFPQHGIGAEICASVVEDSFGYLDAPVERIAGADVPTPYAANLERMAFPQIEDIVRAVKRVCYRAVPLAATA

SEQ ID NO: 7040 - protein, 372 aa, Aristolochia fimbriata
MWGILRQKVGRGGFPASILGQSLRRIQPAASVLPRTFSSAAKEITVRDALNSALDEEMSADPKVFLMGEEVGEYQGAYKISKGLLEKYGPERVLDTPITEAGFTGIGVGSAYYGLKPVVEFMTFNFSMQAIDHIINSAAKSNYMSAGQINVPIVFRGPNGAAAGVGAQHSQCYAAWYGACPGLKVLAPYSSQDARGLLKAAIRDPDPVVFLENELLYGESFPVSPEALDSSFCLPIGKAKIEREGKHVTITAFSKMVGYALKAAEELSKNGISAEVINLRSVRPLDRAAINASVRKTSRLVTVEEGFPQHGVGAEICASVVEESFDYLDAPVERIAGADVPMPYAANLERMAVPQVEDIVRAAKRACYRSCP

SEQ ID NO: 7041 - protein, 380 aa, Cephalotaxus harringtonia
MLGALQKKSATSLINLVSLLRHGQESERVAPMVCTQLRNLSSAAKELTVRDALNSALEEEMSADPKVFLMGEEVGEYQGAYKISKGLLQKFGPDRVIDTPITEAGFTGIGVGAAYYGLKPIVEFMTFNFAMQAIDHIINSAAKSNYMSAGQISVPIVFRGPNGAAAGVGAQHSQCYAAWYGSCPGLKVLVPYSSEDARGLLKAAIRDPDPVIFLENELIYGESFPVSAECLDSSFCLPIGKAKIEKEGKDVTITAFSKMVGYALQAAQELAKEGINAEVINLRSIRPLDRATINASVRKTNRLVTVEEGFPQHGIGAEICASVIEESFEYLDAPVERIAGADVPMPYAANLERLAVPQVEDIIRAAKRACYREVPMSATA

SEQ ID NO: 7042 - protein, 379 aa, Podocarpus macrophillus
MWGSLRQKSAIGLLTLVSSLRNGQVERMGAMVSTPLRKLSTASTEMTVRDALNSALDEEMSADPNVFLMGEEVGEYQGAYKISKGLLQKFGPDRVLDTPITEAGFTGIGVGAAYYGLKPIVEFMTFNFAMQAIDHIINSAAKSYYMSAGQISVPMVFRGPNGAAAGVAAQHSQCYAAWYGAIPGLKVLVPYSSEDARGLLKAAIRDPDPVVFLENELIYGESFPVSAECLDSSFCLPIGKAKIEREGKDVTITAFSKMVGYALKAAQELEKDGISAEVINLRSIRPLDRATINASVRKTNRLVTVEEGFPQHGVGAEICMSVIEESFEYLDAPVERIAGADVPMPYAANLERLAVPQVEDIVRAAKRACYREVRMSAVA

SEQ ID NO: 7043 - protein, 374 aa, Senecio madagascariensis
MLGIIRQKAGLSSQGVGSYVMRLRPVASSATRHYASGTKEMTVRDALNSALDEEMAADPNVYVMGEEVGEYQGAYKITKGLLDKYGPERVVDTPITEAGFAGIGVGSAYHGLRPVIEFMTFNFSMQAIDHIINSAAKSNYMSAGQINVPIVFRGPNGLAAGVGAQHSQCYGAWYGSVPGLKVLVPYSSEDARGLLKAAIRDPDPVVFLENELLYGESFPVSAEALDSSFCLPIGKAKIEREGKDITITAFSKMVGYALKAAEILEKDGINAEVINLRSIRPLDRATINASVRKTNRLLTVEEGFPQHGIGAEICASVVEESFAYLDAPVERIAGADVPTPYAANLERMAFPQIEDIVRAAKRVCYRSVPMAASA

SEQ ID NO: 7044 - protein, 377 aa, Arnica chamissonis
MWGIVRQNVGGARGLSSQGLGNYMMRLRPVASAMRNYSSATKEMTVRDALNSALDEEMAADPNVFVMGEEVGEYQGAYKITKGLLDKYGPERVVDTPITEAGFAGIGVGSAYHGLRPVIEFMTFNFSMQAIDHVINSAAKSNYMSAGQINVPIVFRGPNGPAAGVGAQHSQCYGAWYGSVPGLKVLVPYSSEDARGLLKAAIRDPDPVVFLENELLYGESFPISAEALDSSFCLPIGKAKIEREGKDITITAFSKMVGYALKAAEILEKDGINAEVINLRSIRPLDRATINASVRKTNRLVTVEEGFPQHGIGAEICASVVEDSFGYLDAPVERVAGADVPTPYAANLERMAFPQIEDIVRAARRACYRSVPMAATA

SEQ ID NO: 7045 - protein, 536 aa, Cedrus atlantica
MDLRLLFRGFSIACLLLLFSQHGLCGDIVHDDDVAPKQPGCDNKFVLVKIQTYINGRKGNEYVGVSARFGTPVESKEKVANKSRLVLANPYDSCTTLGEKLTGDAALVLRGNCNFTTKARVAQAAGAVALLVVNDKEELYKMVCAPNDTTLDIKIPAVMLPKTAGASLRKRLSAGGAVGVVIYSPDRPLVDIAEVFLWLMAVGTILCASFWSAWSAREACNEHCKSLKDNPDAFVMEESSGDKGVVDISTTSAILFIVIASCFLILIYKFMSEWFLELLVVIFCIGGVEGLQTCLVALLSRWFSRAGRLYIHVPFFGAVSGLTLAVLPFCITFAVVWAVYRRISFAWIGQDILGITLIITVLQIVRLPNVKVSAVLLGCAFLYDIFWVFVSPKLFHESVMIVVARGDRSGEDGIPMLLKIPRLYDPWGGYSIIGFGDILLPGLLIAFALRYDWAAKKSLQAGYFLWSMIGYGFGLFITYVALNLMDGNGQPALLYIVPCTLGTVLALGWKRGELSNLWSKGEPQMLCPHVGPKGGT

SEQ ID NO: 7046 - protein, 372 aa, Aristolochia fimbriata
MWGIMRQKVGRGGFPAMILGQSLRRIQPAASVLPRTFSTAAKEITVRDALNSALDEEMSADPKVFLMGEEVGEYQGAYKISRGLLEKYGPERVLDTPITEAGFTGIGVGSAYYGLKPVVEFMTFNFSMQAIDHIINSAAKANYMSAGQINVPIVFRGPNGAAAGVGAQHSQCYAAWYGSCPGLKVLAPYSSEDARGLLKAAIRDPDPVVFLENELLYGESFPVSAEALDSSFCLPIGKAKIEREGKHVTITAFSKMVGYALKAAEELSKDGISAEVINLRSVRPLDRAAINASVRKTSRLVTIEEGFPQHGVGAEICASVVEESFDYLDAPVERIAGADVPMPYAANLERMAVPQVEDIVRAAKRVCYRSYP

SEQ ID NO: 7047 - protein, 380 aa, Taxus baccata
MLGALRQKSATSLINLVSSLRHGQGSETVVPMISTQFRNSSTAAKEMTVRDALNSAIEEEMSADPKVFLMGEEVGEYQGAYKVSKGLLQKFGPDRVIDTPITEAGFTGIGVGAAYYGLKPIVEFMTFNFAMQAIDHIINSAAKSNYMSAGQISVPIVFRGPNGAAAGVGAQHSQCYAAWYGSCPGLKVLVPYSSEDARGLLKAAIRDPDPVIFLENELIYGESFPVSAECLDSSFCLPIGKAKIEKEGKDVTITAFSKMVGYALQAARELAKEGINAEVINLRSIRPLDRATINASVRKTNRLVTVEEGFPQHGIGAEICTSVIEESFEYLDAPVERIAGADVPMPYAANLERLAVPQVEDIIRAAKRACYREVRMSAAA

SEQ ID NO: 7048 - protein, 364 aa, Brassica napus
MWGILRQRGIDGGGLSLRRTRSALVSARSYAAGSKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIERQGKDVTIVTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQVEDIVRAAKRACYRSK

SEQ ID NO: 7049 - protein, 368 aa, Catharanthus roseus
MAGALRKIVGCRGTPVSGIRVIGSRAYSSLVKQMTVRDALNSALDEEMSADSSVFLMGEEVGEYQGAYKISKGLLEKYGPDRVIDTPITEAGFAGIAVGAAYKGLKPVIEFMTINFSLQAIDHIINSAAKSNYMSAGQISVPIVFRGPNGAAAGVAAQHSQCYASWYGSVPGLKVLAPYSAEDARGLLKAAIRDPDPVVFLENELMYGESFPVSSEALDSSFCLPIGKAKVEREGKDVTITAFSKMVGYALKAAEILEKEGISAEVINLRSIRPLDRATINSSVRKTNRLVTVDEGFPQHGVGAEICACVVEESFEYLDAPVERIAGADVPMPYGANLERMAVPQVEDIVRATKRTCYRSSVPLAAAA

SEQ ID NO: 7050 - protein, 334 aa, Distylium racemosum
MTVRDALNSAIDEEMSADPSVFLMGEEVGEYQGAYKVSKGLLQKFGPDRVLDTPITEAGFTGIGVGAAYYGLRPIVEFMTFNFAMQAIDHIINSAAKSNYMSAGQISVPIVFRGPNGAAAGVAAQHSQCYAAWYAACPGLKVLSPYSSEDARGLLKAAIRDPDPVVFLENELLYGESFPVSAECLDSSFCLPIGKAKIEREGKDVTITAFSKMVGYALKAAEELAKEGIRAEVINLRSIRPLDRATINASVRKTNRLVTVEEGFPQHGVGAEICTSVIEESFEYLDAPVERIAGADVPMPYAANLERLAVPQVDDIIRAAKRACYREVPMSAAA

SEQ ID NO: 7051 - protein, 369 aa, Fagopyrum esculentum
MSRIMMQKIANGGVSSSRLWRLQQAARAFSSGGKEMTVRDALNSALDEEMAADSRVFVMGEEVGEYQGAYKITKGLLDKYGPERVIDTPITEAGFAGIGVGAAYKGLRPVIEFMTFNFSMQAIDHIINSAAKSNYMSAGQLSVPIVFRGPNGAAAGVGAQHSQCYAAWYGSCPGLKVLCPYSAEDARGLLKAAIRDPDPVVFLENELLYGESFPISEEALDSSFCLPIGKAKIERPGKDVTIIAFSKMVGYALKAADILEKEGINAEVINLRTIRPLDRATINESVRKTNRLVTLEEGFPQHGVGAEICATVVEDSFEYLDAPVERITGADIPMPYAANLERLAVPQIDDIVRAAKRTCYRSVPMAATA

SEQ ID NO: 7052 - protein, 369 aa, Fagopyrum esculentum
MSRIMMQKIANGGVSSSRLWRLQQAARAFSSGGKEMTVRDALNSALDEEMAADSRVFVMGEEVGEYQGAYKITKGLLDKYGPERVIDTPITEAGFAGIGVGAAYKGLRPVIEFMTFNFSMQAIDHIINSAAKSNYMSAGQLSVPIVFRGPNGAAAGVGAQHSQCYAAWYGSCPGLKVLCPYSAEDARGLLKAAIRDPDPVVFLENELLYGESFPISEEALDSSFCLPIGKAKIERPGKDVTIIAFSKMVGYALKAADILEKEGINAEVINLRTIRPLDRATINESVRKTNRLVTLEEGFPQHGVGAEICASVVEDSFEYLDAPVERITGADIPMPYAANLERLAVPQIDDIVRAAKRTCYRSIPMAATA

SEQ ID NO: 7053 - protein, 334 aa, Sequoia sempervirens
MTVRDALNSALEEEMSADPKVFLMGEEVGEYQGAYKISKGLLQKFGPDRVLDTPITEAGFTGIGVGAAYYGLKPVVEFMTFNFAMQAIDHIINSAAKSNYMSAGQISVPIVFRGPNGAAAGVGAQHSQCYAAWYGSCPGLKVLVPYSSEDARGLLKAAIRDPDPVIFLENELLYGESFPVSAESLDSSFCLPIGKAKIEKEGKDVTITAFSKMVGYALQAAQELAKEGISAEVINLRSIRPLDRATINASVRKTNRLVTVEEGFPQHGIGAEICTSVVEESFEYLDAPVERIAGADVPMPYAANLERLAVPQVEDIIRAAKRACYREVPMSATA

SEQ ID NO: 7054 - protein, 369 aa, Silene vulgaris
MSSLVRQVINTGRLSSSRVQALQHVARTFATGGKQMTVRDALNSAIDEEMAADPKVFVMGEEVGEYQGAYKITKGLLDKYGPQRVIDTPITEAGFAGIGVGAAYKDLRPVIEFMTFNFSMQAIDHIINSAAKSNYMSAGQISVPIVFRGPNGAAAGVGAQHSQCYAAWYGSCPGLKVLCPYSAEDARGLLKAAIRDPDPVVFLENELLYGESFPVSEEVLDSNFTLPIGKAKIERQGKDVTITAFSKMVGYALQAAEILAKDGISAEVINLRSIRPLDRATINESVRRTNRLVTLEEGFPQHGVGAEICASVVEDSFGYLDAPVERISGADIPMPYAANLEKLAVPQIEDIVRACKRACHRSVPMAATA

SEQ ID NO: 7055 - protein, 360 aa, Trigonella foenum-graecum
MLGVIRNKSIRPSFSTFRFLSSSAKQMTVRDALNSALDEEMSADSKVFLMGEEVGEYQGAYKITKGLLEKYGPERVLDTPITEAGFTGIGVGAAYYGLKPVVEFMTFNFSMQAIDHIINSAAKSNYMSAGQINVPIVFRGPNGAAAGVGAQHSHCYASWYGSCPGLKVLAPYSSEDARGLLKAAIRDPDPVVFLENELLYGESFPLSAEVLDSSFCLPIGKAKIEREGKDVTITAFSKMVGFALKAAEILAKEGISAEVINLRSIRPLDRSTINASVRKTNRLVTVEEGFPQHGVGAEICASVIEESFGYLDAPVERIAGSDVPMPYAANLERLAVPQIEDIVRAAKRACHRSVPMAATA

SEQ ID NO: 7056 - protein, 373 aa, Aquilegia formosa
MLGSLRHKVIGQLLQRIRPSFSATRSYASSSSVKEMTVRDALNSALDEEMSADPKVFVMGEEVGEYQGAYKITKGLLDKYGPERVVDTPITEAGFTGIGVGAAYHGLRPVIEFMTFNFSLQAIDHIINSAAKSNYMSAGQISVPIVFRGPNGAAAGVGAQHSQCYAAWYASCPGLKVLAPYSSEDARGLLKAAIRDPDPVVFLENELLYGESFPIPAEALDSSFSLPIGKAKIEREGKDVTIVAYSKMVGYAIQAAEILSKEGISAEVINLRSIRPLDRPAINASVRKTNRLVTVEEGFPQHGVGAEICASVVEESFEYLDAPVERISGADVPMPYTANLERMAVPQVEDIVRAAKRACFRSRSVEGLVAQQN

SEQ ID NO: 7057 - protein, 367 aa, Solanum tuberosum
MSGIIGRTMANRRISDLNKFLVGSRVFASRTYSSAVKEMTVRDALNSALDEEMSADPKVFVMGEEVGEYQGAYKITKGLLTKYGPQRVIDTPITEAGFTGIGVGAAYHGLRPVIEFMTFNFSMQAIDHIINSAAKSNYMSAGQISVPIVFRGPNGAAAGVGAQHSQCYAAWYGACPGLKVLTPYSSEDARGLLKAAIRDPDPVVFLENELLYGESFPISAEALDSSFSLPIGKAKIEREGKDVTITAFSKMVGYALKAAEILAKEGISAEVINLRSIRPLDRPAINASVRKTNRLVTVEEGFPQHGVGAEICASVVEESFEYLDAPIERITGADVPMPYAANLERLAVPQVEDIVRAVKRVCYRSSK

SEQ ID NO: 7058 - protein, 368 aa, Raphanus sativus
MWGILRRSAVDGGGFSAASSLGKTRFALVSARSYAAGSKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTITTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQVEDIVRAAKRACYRSK

SEQ ID NO: 7059 - protein, 367 aa, Solanum lycopersicum
MSGIIGRTMANRRISDLNKFLVGSRLFASRTYSSAVKEMTVRDALNSALDEEMSADPKVFVMGEEVGEYQGAYKITKGLLAKYGPQRVIDTPITEAGFTGIGVGAAYHGLRPVIEFMTFNFSMQAIDHIINSAAKSNYMSAGQISVPIVFRGPNGAAAGVGAQHSQCYAAWYGACPGLKVLAPYSSEDARGLLKAAIRDPDPVVFLENELLYGESFPISAEALDSSFSLPIGKAKIEREGKDVTITAFSKMVGYAIKAAELLAKEGISAEVINLRSIRPLDRPAINASVRKTNRLVTVEEGFPQHGVGAEICASVVEESFEYLDAPVERISGADVPMPYAANLERLAVPQVEDIVRAVKRVCYRSSK

SEQ ID NO: 7060 - protein, 363 aa, Arabidopsis thaliana
MLGILRQRAIDGASTLRRTRFALVSARSYAAGAKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTIVTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQIEDIVRASKRACYRSK

SEQ ID NO: 7061 - protein, 362 aa, Gossypium hirsutum
MLGIVRQKMLEQSLKKIRPAVSVLRSYSSAAKQMTVREALNSALDEEMSADSKVFLMGEEVGEYQGAYKITKGLLDKYGPERVLDTPITEAGFTGIAVGAAYYGVKPVVEFMTFNFSMQAIDHIINSAAKTNYMSSGRISVPIVFRGPNGAAAGVGAQHSQCYAAWYASCPGLKVLAPYSSEDARGLLKAGIRDPDPVVFLENELLYGESFPVSDEVLDSSFCLPIGKAKIERKGKDVTIAAYSKMVGYALKAAETLEKDGIDAEVINLRSIRPLDRSTINASVRKTNRLVTVEEAFPQHGVGAEICASIVEESFAYLDAPVERIAGADVPMPYAANLERMAVPQVEDIVRAAKRTCYRSVS

SEQ ID NO: 7062 - protein, 380 aa, Eucalyptus grandis
MLSVLRRKAAAAAVGGSDAMLLGGRLRKSCAAAAAGLRGYATAAKEMTVREALNSALDEEMSADPKVFLMGEEVGEYQGAYKVSKGFLPKFGPERVVDTPITEAGFTGIGVGAAYYGLKPVVEFMTFNFAMQAIDHIINSAAKTNYMSAGNISVPIVFRGPNGAAAGVGAQHSQCYAAWYGSCPGLKVLAPYSSEDARGLLKAAIRDPDPVVFLENELMYGERFPVSAEALDSSFCLPIGKAKIEREGKDVTITAFSKMVGLSLEAAEILAKEGITAEVINLLSIRPLDRPTINASVRKTNRLVTVEEGFPQHGVGAEICMSIIEDSFGYLDAPIERITGADVPMPYAANLERMALPQIEDIVRAAKRVCHRSVPMAATA

SEQ ID NO: 7063 - protein, 367 aa, Brassica napus
MWGILRRSAVDGGGFSASSLRRTRSALVSARSYASGSKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTITTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQVEDIVRAAKRACYRSK

SEQ ID NO: 7064 - protein, 364 aa, Raphanus sativus
MWGILRRRAVVDGGLSLRRTRSALVSARSYAAGSKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTIVTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQVEDIVRAAKRACYRSK

SEQ ID NO: 7065 - protein, 366 aa, Silene vulgaris
MSWLARKVITDARLTSSSSRVRALQHAARSFATGGGKEMTVRDALNSALDEEMAADPKVFVMGEEVGEYQGAYKITKGLLDKYGPQRVIDTPITEAGFTGIGVGAAYKELRPVIEFMTFNFSMQAIDHIINSAAKSNYMSAGQISVPIVFRGPNGAAAGVGAQHSQCYAAWYGACPGLKVLAPYSSEDARGLLKAAIRDPDPVVFLENELLYGESFPVSEKVLDPNFVLPIGKAKIERQGKDVTITAFSKMVGYALQAAEILAKDGISAEVVNLRSIRPLDRATINESVRKTSRLVTVEEGFPQHGVGAEICATVVEDSFGYLDAPVERIAGADVPMPYAANLERMAVPQVEDIVRAAKRACYRSA

SEQ ID NO: 7066 - protein, 367 aa, Solanum phureja
MSGIIGRTMANRRISDLNKFLVGSRVFASRTYSSAVKEMTVRDALNSALDEEMSADPKVFVMGEEVGEYQGAYKITKGLLTKYGPQRVIDTPITEAGFTGIGVGAAYHGLRPVIEFMTFNFSMQAIDHIINSAAKSNYMSAGQISVPIVFRGPNGAAAGVGAQHSQCYAAWYSACPGLKVLTPYSSEDARGLLKAAIRDPDPVVFLENELLYGESFPISAEALDSSFSLPIGKAKIEHEGKDVTITAFSKMVGYALKAAEILAKEGISAEVINLRSIRPLDRPAINASVRKTNRLVTVEEGFPQHGVGAEICASVVEESFEYLDAPIERITGADVPMPYAANLERLAVPQVEDIVRAVKRVCYRSSK

SEQ ID NO: 7067 - protein, 366 aa, Arabidopsis lyrata
MLGILRQRAIDGGLAASTLRRTRFALVSARSYAAGAKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLTPYSAEDARGLLKAAIRDPDPVVFLENELLYGESFPISEEALDSSFCLPIGKAKIEREGKDVTIVTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQIEDIVRASKRACYRSK

SEQ ID NO: 7068 - protein, 366 aa, Brassica oleracea
  misc_feature (363)..(363): Xaa can be any naturally occurring amino acid
MWGILGRRAVDGGFSASSLRRMRSGLVSARSYAAGSKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTITTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQVEDIVRAAKRACXRSK

SEQ ID NO: 7069 - protein, 366 aa, Brassica rapa
MWGILGRRAVDGGLSASSLRRMRSGLVSARSYAAGSKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTITTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQVEDIVRAAKRACFRSK

SEQ ID NO: 7070 - protein, 366 aa, Brassica napus
MWGILGRRAVDGGFSASSFRRMRSGLVSARSYAAGSKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTITTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQVEDIVRAAKRACFRSK

SEQ ID NO: 7071 - protein, 360 aa, Arnica chamissonis
ATGLSSQGLGNHMLRLRPVTSALRNYSSATKEMMVRDALNSALDEEMAADPNVFVMGEEVGEYQGAYKITKGLLDKYGPERVVDTPITEAGFTGIGVGSAYHGLRPVIEFMTFNFSMQAIDHIINSAAKSNYMSAGKINVPIVFRGPNGPAAGVGAQHSQCYGAWYGSVPGLKVLVPYSSEDARGLLKAAIRDPDPVVFLENEMLYGESFPVSAEALDSSFCLPIGKAKIEREGKDITITAFSKMVGYALKAAEILEKEGINAEVINLRSIRPLDRATINASVRKTNRLVTVEEGFPQHGIGAEICASVVEDSFGYLDAPVERIAGADVPTPYAANLERMAFPQIEDIVRAAKRVCYRSV

SEQ ID NO: 7072 - protein, 350 aa, Lactuca sativa
MWGIIRQNVGGARDLSSQVLGSSLMRLKPITSAMRHYSSATKEMTVRDALNSALDEEMAADPNVFVMGEEVGEYQGAYKITKGLLDKYGPERVVDTPITEAGFAGIGVGSAYHGLRPVIEFMTFNFSMQAIDHIINSAAKSNYMSAGQINVPIVFRGPNGPAAGVGAQHSQCYGAWYGSVPGLKVVVPYSSEDARGLLKAAIRDPDPVVFLENELLYGESFPVSAEALDSSFCLPIGKAKIEREGKDITITAFSKMVGYALKAAEILEKEGISAEVINLRSIRPLDRGTINASVRKTNRLVTVEEGFPQHGVGAEICASVVEDSFGYLDAPVERIAGADVPTPYAANRCR

SEQ ID NO: 7073 - protein, 359 aa, Pisum sativum
MLGVIRNKTIRPSFSAFRFFSSAKQMTVRDALNSALDVEMSADSKVFLMGEEVGEYQGAYKITKGLLEKYGPERVLDTPITEAGFTGIGVGAAYYGLKPVVEFMTFNFSMQAIDHIINSAAKSNYMSAGQISVPIVFRGLNGDAAGVGAQHSHCYASWYGSCPGLKVLAPYSAEDARGLLKAAIRDPDPVVFLENELLYGESFPVSAEVLDSSFWLPIGKAKIEREGKDVTITAFSKMVGFALKAAEILEKEGISAEVINLRSIRPLDRPTINASVRKTNRLVTVEEGFPQHGVGAEICTSVIEESFGYLDAPVERIAGADVPMPYAANLERLAVPHVEDIVRAAKRACHRSVPLAAAA

SEQ ID NO: 7074 - protein, 373 aa, Zostera marina
MLGVLSRKACSISVLDRSPWTIRHALPVSTRNYSTATKEMTVRDALNSALDEEMSADSRVFMIGEEVGEYQGAYKISKGLLDKYGPDRVRDTPITEAGFAGIAVGAAYHGLRPVVEFMTFNFSMQAIDHIVNSAAKMNYMSAGEISVPIVFRGPNGAAAGVSSQHSQCYGAWYGSIPGLKVLTPYSSEDARGLLKSAIRDPDPVVFLENELLYGESFPVTEEVMDSSFCVPIGKAKIEREGKDVTIVTFSKMVGYSLKAAELLSKEGISAEVINLRSIRPLDRDTINASVRKTNRLVTVEEGFPQHGIGAEICASVVEESFEYLDAAVERIAGADVPTPYAVNLERMAVPQIEDIVRAAKRACYRSVSMAVAA

SEQ ID NO: 7075 - protein, 369 aa, Raphanus sativus
MWGILGRRAVVVDGGFSASCLRSRMRSGLVSARSYAAGSKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTITTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQVEDIVRAAKRACFRSK

SEQ ID NO: 7076 - protein, 371 aa, Aquilegia formosa
MLGTLRQKVFSTGVSSSSVIGQSLLRIRPSFSATRSYASSVKEMTVRDALNSALDEEMSADPKVFVMGEEVGEYQGAYKITKGLLDKYGPERVVDTPITEAGFTGIGVGAAYHGLRPVIEFMTFNFSMQAIDHIINSAAKSNYMSAGQISVPIVFRGPNGAAAGVGAQHSQCYAAWFGSCPGLKVLAPYSSEDARGLLKAAIRDPDPVVFLENELLYGESFPISAEALDSSFALPIGKAKIEREGKDVTIVTYSKMVGYSIQAAEILSKEGISAEVINLRSIRPLDRPAINASVRKTNRLITVEEGFPQHGVGAEICASVVEESFEYLDAPVERISGADVPMPYAANLERMAVPQVEDIVRAAKRACFRSS

SEQ ID NO: 7077 - protein, 362 aa, Gossypium hirsutum
MLGIVRQKMLEQSLKKIPPAVSVLRSYSSAAKQMTIRDALNSALDEEMSADSKVFLMGEEVGEYQGAYKITKGLLDKYGPERVLDTPITEAGFTGVAVGAAYYGVKPVVEFMTFNFSMQAIDHIINSAAKTNYMSSGQISVPIVFRGPNGAAAGVGAQHSQCYAAWYASCPGLKVLAPYSSEDARGLLKAAIRDPDPVVFLENELLYGESFPVSDEVLDSSFCLPIGKAKIERKGKDVTIAAYSKMVGYALKAAETLEKDGIDAEVINLRSIRPLDRSMINASVRKTSRLVTVEEAFPQHGVGAEICASIVEESFAYLDAPVERIAGADVPMPYAANLERMAVPQVEDIVRAAKRTCYRSVS

SEQ ID NO: 7078 - protein, 368 aa, Vinca minor
MLGILKQKVRVGTKQKILSPAVSAIRSYSSASKKMMVREALNSALDEEMAADPRVFLMGEEVGEYQGAYKVSKGLLQKYGPERVVDTPITEAGFTGLGVGAAFYGLRPIVEFMTFNFAMQAIDHIINSAAKTNYMSSGNISVPIVFRGPNGAAAGVGAQHSQCYAPWYGSVPGMKVLAPYSSEDARGLLKAAIRDPDPVVFLENELLYGESFPVSEDVLDSSFSLPIGKAKIEREGTDVTIATFSKMVGYALKAAEILEKEEIDAEVINLRSIRPLDRAAINDSVRKTNRLVTVEEGFPQHGVGAEICASVAEESFQYLDAPVERIAGADVPMPYSANLERLALPQVEDVVRAAKRACYRAVSTAATA

SEQ ID NO: 7079 - protein, 364 aa, Fagopyrum esculentum
MSRIMMQKIVRGGVSSTRFWRMHQAARAFSSGGKEMTVRDALNSAIDEEMAADSKVFVMGEEVGEYQGAYKITKGLLDKYGPERVIDTPITEAGFAGIGVGAAYKGLRPIIEFMTFNFSMQAIDHIINSAAKSNYMSAGQLSVPIVFRGPNGAAAGVGAQHSQCYAAWYGSCPGLKVLCPYSSEDARGLLKAAIRDPDPVVFLENELLYGESFPVSAEVLDSNFCLPIGKAKIERPGKDVTIVTFSKMVGYSLKAADILEKEGISAEIVNLRSIRPLDRATINESVRKTNRLVAVEEGFPQHGVGAEICATVVEDSFEYLDSPVERISGADIPMPYAANLERMAVPQIEDIVRAAKRACYRSSS

SEQ ID NO: 7080 - protein, 402 aa, Euonymus alatus
KRNKQRLVGVAALLRVYFTSRRRSDPAPVLLKKKRCGGLVSQKVLAKSLQPLRPAASAWRGFASGTKEITVREALNSALDEEMSADPKVFLMGEEVGEYQGAYKISKGLLDKYGPERVLDTPITEAGFTGIGVGAAYYGLKPIVEFMTFNFSMQAIDHIINSAAKSNYMSAGQISVPIVFRGPNGAAAGVGAQHSHCYAAWYASCPGLKVLSPYSSEDARGLLKAAIRDPDPVVFLENELLYGESFPVSDEVLDSSFCLPIGKAKIEREGKDVTITAFSKMVGYALKAAETLEKEGISAEVINLRSIRPLDRDTINSSVRKTSRLVTVEEGFPQHGVGAEICTSVVEDSFGYLDAPVERISGADVPMPYAANLERMAVPQVEDIVRAAKRACYRSVSVAATA

SEQ ID NO: 7081 - protein, 802 aa, Sorghum bicolor
MTAPTPRALSQHTARRVGVASSPQGRHSRSSPAPPRHHLHPQHKQQGPTAPSASVLGVGVPRVAWLSQRTPVLGLRAWVLVAAGAAAAALALLCLIVCLCRRCSRRRRTPRLAPCPHRPGAIKSLKHRVHAHHQHEAVPMPPPANKDVEEAAAARWRPRPASFEQPPIEAIRAEQKAPLILAEHFARTSGEETATSSGGSDDAEVPEAAAQRGWGRRYTRREMEEATAGLAPANVMGEGGYGVVFRGVLRDGTAVAIKNLHNNRGQAERDFRMEVQTIGRVRHKNLVSLLGYCSEGACRMLVYEYMENSNLDKWLHHDDSEISPLTWDIRMRILLGTAKGLAYLHEGLEPKIVHRDIKSSNILLDRQWNAKVSDFGLAKLLCSERSYITTRVVGTFGYVAPEYAKTGMLNERSDVYSFGVLVMEVITGRTPVDYTRPTDEVDLVEWLKRMVAERRVEEVLDPRLPEPPPSKALKRAVLAALRCVDPDGSQRPTMPHVVHMLEDDQILRDEFKLARDLSPRESDSYEERERSSNVSLSVLSIAAARNRAPRAHPQGRGCEFVNRDGADASCTPVVVVVAGGIRAHCASAPASTAACSYLSEKLLAFFTTRRRRCASTIRSAATDSSFGTGGDAAPSKKTTRKEKQQERRRQQDLQDRQQQLLMMEEKTSLAKRDGGTGSSSSGGGEVDGDDDELPQPVFDRILRRIAFTVGLPMATGVALLNVYDALKRGQGVVVPSWVPLLTILVAFGTSALGIAYGTLSASWDPDREGSLLGIDEARANWPVLWQEEIQKEKEKKAKQMKK

SEQ ID NO: 7082 - protein, 116 aa, Triticum aestivum
SLSGRQAKSKKRPGKNTHRHRHRQRGEAMATTKMAVVAILAALLLMAAVEPASATPPSMLAARKLQMPRLMDVVLAESKLACLPAGGFCMFRPMDCCGNCGCLYPAGVCYGTRCEE

SEQ ID NO: 7083 - protein, 88 aa, Triticum aestivum
MATTKMAVVAILAALLLMAAVEPASATPPSMLAARKLQMPRLMDVVLAESKLACLPAGGFCMFRPMDCCGNCGCLYPAGVCYGTRCEE

SEQ ID NO: 7084 - protein, 180 aa, Zea mays
MEAVVATTTTRVSFPLLPTAGRPLLPPVLARPRRGFASVSATSTSGAGGGGGRSSAGGCGGDGGGDDSGAGAAAAAAAVAALGESEQQEDGDSDAIVLHVGGMTCGGCADKVKRILESQPEVAAATVDVEKATAIVWTTPEAKATKDWQKQLAEKLANHLTSCGFQSHLQDEGEAEQTDA

SEQ ID NO: 7085 - protein, 583 aa, Sorghum bicolor
MDQLPKRPANYVPLSPVGFLPRANAVYGDRASVIYGRVRFTWRQTYHRCRRLASALLSLGVRRGDVVSVLAPNVPAMYEMHFAVPMAGAVLNTINTRLDAGAVATILRHSGAKLFFVDYDYVRLASDALRLLAADGTPAVPLVAVIDDIDSPTGARLGELEYEALVAHADPDADLPPLEDEWDAVTLNYTSGTTSAPKGVVYSHRGAYLSTTSLLLQWGVTTEPVYLWTLPMFHCNGWTFTWGMAARGGVNVCIRDARPADIYRAIARHRVTHMCCAPVVFSILLEGQGAGDGAARQLEAPVHVLTGGAPPPAALLERVERIGFKVTHAYGLTEATGPALACEWRGQWDRLPLPERARLKARQGVSVLSLADADVKNAETMVSVPRDGKTVGEIVLRGSSVMKGYLNNPEANENAFRGGWFLTGDVGVVHQDGYIEIKDRSKDVIISGGENICSKEVEEVLFRHPAVADAAVVAMPHPYWGETPCAFVVRRNSAAELSEDDVLAFCRKRMARFMVPKKVQVVGALPRNALGKVEKVKLREAARKLAPTVPAQKPKGKTTTSSTTVGGRREDQPVAHVMAVSRL

SEQ ID NO: 7086 - protein, 579 aa, Sorghum bicolor
MDQLPKRPANYVPLSPVGFLPRANAVYGDRASVIYGRVRFTWRQTYHRCRRLASALLSLGVRRGDVVSVLAPNVPAMYEMHFAVPMAGAVLNTINTRLDAGAVATILRHSGAKLFFVDYDYVRLASDALRLLAADGTPAVPLVAVIDDIDSPTGARLGELEYEALVAHADPDADLPPLEDEWDAVTLNYTSGTTSAPKGVVYSHRGAYLSTTSLLLQWGVTTEPVYLWTLPMFHCNGWTFTWGMAARGGVNVCIRDARPADIYRAIARHRVTHMCCAPVVFSILLEGQGAGDGAARQLEAPVHVLTGGAPPPAALLERVERIGFKVTHAYGLTEATGPALACEWRGQWDRLPLPERARLKARQGVSVLSLADADVKNAETMVSVPRDGKTVGEIVLRGSSVMKGYLNNPEANENAFRGGWFLTGDVGVVHQDGYIEIKDRSKDVIISGGENICSKEVEEVLFRHPAVADAAVVAMPHPYWGETPCAFVVRRNSAAELSEDDVLAFCRKRMARFMVPKKVQVVGALPRNALGKVEKVKLREAARKLAPTVPAQKPKGKTTTVGGRREDQPVAHVMAVSRL

SEQ ID NO: 7087 - protein, 578 aa, Zea mays
MDQLPKRPANYVPLSPVGFLPRANAVYGDRTSVIYRGVRFTWRQTYARCRRLASALLSLGVVRRGDVVSVLAPNVPAMYEMHFAVPMAGAVLNTINTRLDAAAVATILRHSGAKLFFVDYDYVRLASDALRLLDAADVPLVAVIDDIHSPTGARLGELEYEALLAHGDPDADLPPLQDEWDAVTLSYTSGTTSAPKGVVYSHRGAYLSTTSLLLQWGVPAEPVYLWTLPMFHCNGWTFTWGMAARGGVNVCIRDARPADIYRAIARHRVTHMCCAPVVFSILLDGDGDSDGAARQLQAPVHVLTGGAPPPAALLERVERIGFNVTHAYGLTEATGPALACEWRDQWDRLPLPERARLKARQGVSVLSLADADVKNADTMLSVPRDGRTVGEIVLRGSSVMKGYLNNPEANESAFRAGWFLTGDVGVVHPDGYIEIKDRSKDVIISGGENICSKELEEVLFRHPAVADAAVVAMPHPRWGETPCAFVVPRDKAAVLSEGDVLAFCSKRMARFMVPKKVEVVGALPRNALGKVEKVKLREAARKLAPTVAAAQKPKAKTTTVGGRRDGQPVAHVMAVSRL

SEQ ID NO: 7088 - protein, 577 aa, Zea mays
MDQLPKRPANYVPLSPVGFLARANAVYADRASVVYGGVRFTWRQTYERCRRLASALLSLGVRRGDVVSVLAPNVPAMYEMHFAVPMAGAVLNAINTRLDAAAVATILRHSGAKLFFVDYDYVRLAGDALRLLAAAAGGTVPLVAVVDDIDSPTGARLGELEYEALVAHGDPDADLPPLADEWDAVTLNYTSGTTSAPKGVVYSHRGAYLSTTSLLLQWGVATDPVYLWTLPMFHCNGWTFTWGMAARGGVNVCIRDARRADIYRAIARHRVTHMCCAPVVFSILLDGDGDGDGRQLEAPVHVLTGGAPPPAALLERVERIGFKVTHAYGLTEATGPALACEWRDQWDRLPLPERARLKARQGISVLSLADADVKNVDTMASVPRDGKSLGEIVLRGSSVMKGYLNNPEANDGAFRGGWFLTGDVGVVHPDGYIEIKDRSKDVIISGGENICSKEVEEVLFRHPAVADAAVVAMPHPRWGETPCAFVVPRDGKAHGLSEDDVLAFCARRMARFMVPKKVEVIGALPRNALGKVEKVKLREAARKLAPTVPAQIKPKGKTTTSTVVGGGRCEEQPVSRL

SEQ ID NO: 7089 - protein, 439 aa, Setaria italica
MNQLPKRPANYVPLSPVGFLPRANAVYGDRLSVIYGRVRFTWSETYRRCRSFASALLALGIRRGDVVSVLAPNVPAMYEMHFAVPMAGAVLNTINTRLDANAVATILRHSEAKLFFVDYDCVRLAGDALRLLAAEAGRHVPLVAVIDDIDAPTGVRLGELEYEGLVAHGDAEAELPPLADEWDAVTLNYTSGTTSAPKGVVYSHRGAYLSTTSLLLQWGVGTEPVYLWTLPMFHCNGWTFTWGMAARGGVNVCIRDARAADIYRAIARHRVTHMCCAPVVFSILLEGDDATSSKRQLEAPVHVLTGGAPPPAALLERVERIGFRVTHAYGLTEATGPALACQWDRLPLPERARLKARQGVSVLSLADADVKNADTQRAARREDLGGDRAPRQQRHEGLPQQPQGQRGGLQGRLVPDGRRRRRARGRVHRDQGQVQGRDH

SEQ ID NO: 7090 - protein, 578 aa, Oryza sativa
MEQLPKRPANYVPLSPVGFLPRANAVYGDRTSVIYGRVRFTWSQTYARCRRLASSLLSLGVRNHDVVSVLAPNVPAMYEMHFAVPMAGAVLNTINTRLDARAVAGILRHSEAKVFFVDYQYVRLASDALQIVADEGRHVPLVAVIDDIDVPTGVRLGELEYEGLVARGDPAAELPSLADEWDAVTLNYTSGTTSAPKGVVYSHRGAYLSTMSLLMSWVVGDEPVYLWTLPMFHCNGWTFTWGMAARGGVNVCIRDARAADIYRAIARHGVTHLCCAPVVFNILLEGGEAAAKQLAAPVHVLTGGAPPPAALLERVERIGFRVTHAYGLTEATGPALACEWRAQWDRLPLPERARLKSRQGVSVLSLADADVKDAKTMARVPRDGKTVGEIVLRGSSIMKGYLNNPEANSDAFKGEWFLTGDVGVVHADGYIEIKDRSKDVIISGGENICSKEVEEVLFQHPAVADAAVVAMPHPHWGETPCAFVVARDKAAGVCEDDVVAFCRKHMARFMVPKKVVVYDAIPRNGNGKVEKNLLREAAKKLAPAAVPAQKTKVKTTTTTVGGRRGEHPVAHVMAVSRL

SEQ ID NO: 7091 - protein, 91 aa, Panicum virgatum
MKKQQQAVVLLLLLLLAAGGASAASCNAGQLTVCASALTSGGKPSAACCSNLKAQQGCFCQFAKNPAFARYINSPTARKVVASCGVALPRC

SEQ ID NO: 7092 - protein, 90 aa, Panicum virgatum
MKKQQQAVVLLLLLVAAGGASAASCNAGQLTVCASALTSGGKPSAACCSNLKEQQGCFCQFAKNPAFARYINSPTARKVVASCGVALPRC

SEQ ID NO: 7093 - protein, 91 aa, Panicum virgatum
MKKQQQAVVLLLLLLVAAGGASAASCNAGQLTVCASALTSGGKPSAACCSNLKAQQGCFCQFAKNPAFARYINSPTARKVVASCGVALPRC

SEQ ID NO: 7094 - protein, 880 aa, Oryza sativa
MGGGRKRGRTQRRHFKQGRENVWKHNPQRPPAAGGEGAEGGAAEGREGNPSWQPFATENPAFEDYYKAQQIIPEGEWDDFMNMLRKPLPATFRINASCQFYQDICSQLENDFRKSLETEVSDEHEEDAIRPLPWYPGNLAWHLNFSRMQLRRNQALEGFHEFLKRENEVGNITRQEAVSMVPPLFLNVQPDHHILDMCAAPGSKTFQLLEMIHQSTKPGMLPNALVVANDVDVQRCNLLIHQTKRMCTANLIVTNHEAQNFPGCNLAKFSSETCTDESKLQRLEFDRVLCDVPCSGDGTVRKAPDMWRKWNAGMGNGLHRLQVEIAMRGIGLLKVGGRIVYSTCSMNPVENEAVVAEILRRCGDSVELLDVSNELPELVRRPGLSTWKVRDRGSWFGTHEDVPRYRKNVISPSMFPSGKGTMDSHVAIGSVEINTDVIDADMKDSTNMVEGEQETKTASDDVNNGGDPNTEETSKLESNEVPNDSDKKSNSTSIRTEHSNFPLHRCMRIVPHDQNSGAFFIAVLQKISPINGNQEAELIKGEHNISKDRAEKLEKGLGSDKVPHKENTVQQQGVDDGNVMDEQQNGDVDNETSNGKSSEEAKVIVNEAENDQAGPRDRRRKPQNQGRWRGVDPVIFFKDEATIRSIVSFYGIKDTFPLEGHLVTRNPDAGHVKRIYYVSKSVQEVLELNVKVGERLKITSLGLKIFERQSSKDGSPCTFRLSSEGLPLLLPYITKQILYASAIDFQHLLQYRTIKFPDFVDAKFGEEASALLPGCCVVVLWEGHQNIDSIAMDPSAIAIVCWKGKTNLCVMVSPLDGKELLERICLRYGLKIPKADDVKPSMKIDGSDEQPDLSTEAVDPEAVPESKASDMEIADAKEVE

SEQ ID NO: 7095 - protein, 170 aa, Saccharum officinarum
MGSQAIEAHRAGAEVYSGAALCAEKSTELLSEVHLPLGLLPLADMEEVGYNRATGFVWLRQKKALTHTFRQIGRQVSYAAEVTAFVEDRRMKRMTGVKTKELLIWVTLSDMFIDKDDEAKITFKTPTGLGRTFPVSAFAKEGAGADAGAAAAKPKDAPAPVAAGKAAASK

SEQ ID NO: 7096 - protein, 172 aa, Setaria italica
MGSQAIEEHRAGAEVYHGAALCAEKSTELLSEVHLPLGLLPLADMEEVGYNRSTGFVWLRQKKALTHTFKQIGRQVSYASEVTAFVEDRRMKRMTGVKTKELLIWVTLSDMFLDKDDPSKITFKTPTGLGRTYPASAFAKEGGDDGGKPVGKEAPAAAANGGNEAAAAVSGK

SEQ ID NO: 7097 - protein, 165 aa, Pennisetum glaucum
MGSQAIEEHRAGAEVYHGAALCAEKSTQLLSEVHLPLGLLPLADMEEVGYNRSTGFVWLRQKKALTHTFKQIGRQVSYAAEVTAFVEDRRMKRMTGVKTKELLIWVTLSDMFLDKDDHSKITFKTPTGLGRTYPVSAFEKEEGEGGGDKEEPAVAKEAPAAAAAN

SEQ ID NO: 7098 - protein, 329 aa, Zea mays
MAASQSATLLLLAVVLAAVAPGPSSARHVINFAPSRAVNPASLAWDPTAQHFVVAGGGDAVLCVSDAGVTESIVSSGASSVAVDDRRRRLLVASPGSVSAFDLRSPRPHRLILSTPVPDPAPPGGIAVDPHTGNAFLTVGARIYKLSVEGDLATLATAPALGSEPLASLTAHVSRGFLLVGQPGTGSILRVDMEDGATRTVSCALTPPTPMAVAVRTDGAVAVGGAAGLRLVVSNDGWASCGVRDEAAPAPDGLVAAVAVRERRRVYALVEAEAVNGVNKWQIEEASWKSESEGEMVVVLVFVGVALAIFMFWRFQMRQLAGNMNKKIR

SEQ ID NO: 7099 - protein, 324 aa, Zea mays
MAFHPATLFLLLVLAAVAPIPSNARHIITFAPSRAVNPASLAWDPTAQHFVVAGGGDAVLSVSDAGVTESIVSSGASCVAVDDRRRRLLVASPGSVSAFDLRSPRPHRLILSTPVADPAPPGGIAVDPHTGNAFLTVGARIYKLSVEGELATLASAPALGSVPLASLTAHVSRGFLLVGQPSSGSVLRVDMEDGATRTVSCALTPTAVAVRTDGAVAVGGAAGLRLVVSNDGWASCGVRDEAAPAPDGPVAAVAVRERRRVYALVGAAAMDGGNKWRIEEASWKSESEGEMVVVLVFVGVALTIFMFWRFQMRQLAGNMNKKIR

SEQ ID NO: 7100 - protein, 342 aa, Panicum virgatum
  misc_feature (260)..(260): Xaa can be any naturally occurring amino acid
  misc_feature (277)..(277): Xaa can be any naturally occurring amino acid
MAASHLPTLLLVLVLAAVAPLPSSARHIITFAPARGVGPASLAWDPTAQHFVVAGGGDAILSVSDAGVTESIISSGASAVAVDDRRRRLLVASPGSVSAFDLRSPRPHRLILSTPVPDTAPPGGIAVDPHTGSAFLTVGARIYKLSLDGDLARSPRAGARVRAPGLAHRAREPRVPARGPAQHGQPPPRRHGGRRHEDRVGRPHATHAGRRCGPDRRGGRGGRGRGAAPHREQRRVGVVRGAGRGAARARRPRGRGGRAXAAAGVRAGGGGDHGRGXGVADRGGGVEIGVGRGDGGGARLRWRRLSHLHVLEVPDAPARQQHEQEDQIVTMQSLLALFLKNL

SEQ ID NO: 7101 - protein, 569 aa, Sorghum bicolor
MLVLFETPAGFALFKVLDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRTNAVDLDFSEILSDEEIETQLKEAAVISMGTEVSDLDLSNIKELCDQVLALSEYRAQLYDYLKSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLENRELGKSAGSIKGKPKIEVYEKDRKKGAGALTTPAKTYNPAADLVLTEETPKKSELASKKRKHHEVKTEPSAVPAEEAIQEDGDQEDRKKKKKKKSKESEEAPAVEGDGEKKKKKKSKEAQEEPAVAAASEGEKKKKKKKSDADGEDVAMQTEESGKKDKKKKKKKHADDE

SEQ ID NO: 7102 - protein, 567 aa, Pennisetum glaucum
MLVLFETPAGFALFKVLDEGKLDKVEDLWKEFTTSDSARKVVELKAFNKFENTSDALSAATLIIDSKPSKGLRKFLQKHCEGETLGVADSKLGNAIKEKLKIDCIHNSAVMELMRGLRNQLTELITGLGAQELGPMSLGLSHSLSRYKLKFSPEKVDTMIIQAIGLLDDLDKELNTYAMRVREWYGWHFPELTKIVTDNIQYAKVVKMMGNRANAVNLDFSEILSDEEVEAQIKEAAVISMGTEVNDLDLLNIRELCDQVLALSEYRGQLFDYLKSRMNTIAPNLTALVGELVGARLIAHGGSLVNLAKQPGSTIQILGAEKALFRALKTKHSTPKYGLIYHASLIGKASQKHKGKISRSLAAKTALAIRCDALGDGEDNSIGVESRLKLETRLQVLENKEFGKSAGSTKGKPKIEVYEKDRKKGAGALITPAKTYNPAADVVLGQSTEETPKKSDVASKKRKHHDAEVAPTTEPAVEAIQEDGDHERKKKKKKKDKETEVTPAANADGEKKKKKKSKESEEPAVAAAEGEKKKKKSDADGEDVAMQTEESGKKDKKKKKKKHADDE

SEQ ID NO: 7103 - protein, 335 aa, Panicum virgatum
MLVLFETPAGFALFKVLDEGKLDKVDDLWKEFTTSDSARRVVELKAFNKFENTSDALSAATLIIDSKPSKGLRKFLQKHCEGETLAVADSKLGNAIKEKLKIDCVHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRANAVKIDFSEILSDEEVETQLKEAAVISMGTEVSDLDLLNIRELCDQVLALSEYRAQLYDYLKSRMNTIAPNLTALVGELVGARLIAHGGSLLNLAKQPGSTIQILGAEKGFIQSSKDEAFYT

SEQ ID NO: 7104 - protein, 568 aa, Oryza sativa
MLVLFETPAGFALFKVLDEGKLDKVEDLWKEFTTSDSARKVVELKAFNKFENTSDALSAATLIIDSKPTKGLRKFLQKHCEGETLAVADSKLGNAIKEKLKIDCLHNSAVMELMRGLRNQLTELISGLGAQDLGPMSLGLSHSLSRYKLKFSPEKVDTMIIQAIGLLDDLDKELNTYAMRVREWYGWHFPELTKIVADNIQYAKVVKMMGDRTNAESLDFSEILSDDEVEAQLKEAAVISMGTEVSELDLLNIRELCDQVLALSEYRAQLFDYLRSRMNTIAPNLTALVGELVGARLIAHGGSLVNLAKQPGSTIQILGAEKALFRALKTKHATPKYGLIYHASLIGQAAPKHKGKISRSLAAKTALAIRYDALGDGEDNSIGLESRVKLETRLRVLEGKELGRSAGSTKGKPKIEVYEKDRKKGAGALITPAKTYNPAADLVLGQSTEETPKKPEGASKKRKHQEAEPAGAEETIQEDGDQEGQKKKKKKKSKDSEDSPVADADGGKKKKKKSKESEEPPVATAEGEKKEKKKKKKSDSQDAKDVAMETEASGKKDKKKKKKKHGDE

SEQ ID NO: 7105 - protein, 568 aa, Oryza sativa
MLVLFETPAGFALFKVLDEGKLDKVEDLWKEFTTSDSARKVVELKAFNKFENTSDALSAATLIIDSKPTKGLRKFLQKHCEGETLAVADSKLGNAIKEKLKIDCLHNSAVMELMRGLRNQLTELISGLGAQDLGPMSLGLSHSLSRYKLKFSPEKVDTMIIQAIGLLDDLDKELNTYAMRVREWYGWHFPELTKIVADNIQYAKVVKMMGDRTNAESLDFSEILSDDEVEAQLKEAAVISMGTEVSELDLLNIRELCDQVLALSEYRAQLFDYLRSRMNTIAPNLTALVGELVGARLIAHGGSLVNLAKQPGSTIQILGAEKALFRALKTKHATPKYGLIYHASLIGQAAPKHKGKISRSLAAKTALAIRYDALGDGEDNSIGLESRVKLETRLRVLEGKELGRSAGSTKGKPKIEVYEKDRKKGAGALITPAKTYNPAADLVLGQSTEETPKKPEGASKKRKHQETEPAPAEKTTKEDGDQEGEKKKKKKKSKESEESPAADADGGKKKKKTSKESEEPPVATTEGEKKEKKKKKKSDSQDAEDVAMETEESGKKEKKKKKKHHSDE

SEQ ID NO: 7106 - protein, 560 aa, Brachypodium distachyon
MLVLFETPAGFALFKVLDEGKLSKVEDLWKDFASSDKARKVVELKAFNKFENTSDALSAATLLIDSKPSKGLRKFLQKHCDGETLAVADSKLGNAIKEKLKIDCRHDSAVMELMRGLRSQLTELMSGLAEHDLGPMSLGLSHSLSRYKLKFSPEKVDTMIIQAIGLLDDLDKELNTYAMRVREWYGWHFPELTKIVADNIHYAKAVKMMGNRVNAVNLDFSEILPEEVEAELKEAAVISMGTEVNDLDLLNIRELCDQVLALSEYRAQLYDYLKSRMNTIAPNLTALVGELVGARLIAHGGSLMNLAKQPGSTIQILGAEKALFRALKTKHATPKYGLIYHASLIGQAAPKHKGKISRSLAAKTALAIRYDALADGDDNSMGLESRIKLETRLRVLEGKELGRSAGSAKGKPKIEAYEKDRKGAGALITPAKTYNPASDLVLGKSTEETPKKSEVASKKRKHEEAEPTKEATEADGEQEKEKSKKKKKKSKDSEESPAADADGGEKKKKKKNKESEEAPLADADGEKKKKKKKSDAQDVPMETDESSKKEKKKKKKHADE

SEQ ID NO: 7107 - protein, 560 aa, Triticum aestivum
MLVLFETPAGFALFKVLDEGKLSSVEDLWKDFASSDKARKVVELKAFNKFENTSDALSAATLLIDSKPSKGLRKFLQKHCDGETLAVADSKLGNAIKEKLQIDCLHNSAVMELMRGLRNQLTELMSGLAEHDLGPMSLGLSHSLSRYKLKFSPEKVDTMIIQAIGLLDDLDKELNTYAMRVREWYGWHFPELTKIVADNIHYAKAVKMMGNRVNAVNLDFSEILPEEVEAELKEAAVISMGTEVNDLDLSNIRELCDQVLALSEYRAQLYDYLKSRMNTIAPNLTALVGELVGARLIAHGGSLMNLAKQPGSTIQILGAEKALFRALKTKHATPKYGLIYHASLIGQAAPKHKGKISRSLAAKSALAIRYDALADGDDNSMGLESRIKLETRLRVLEGKELGRSAGSTKGKPKIEAYEKDRKGGGALITPAKTYNSAADLVLGQTTEETPKKSEVASKKRKHQEEEPTAEAAEEDGEQEKEKSKKKKKKSKDMEEIPAAVTDASENKKKKKSKETEETPAANTDGEKKKKKKKSDAEDAPMEIDVSAKKDKKKKKKHADE

SEQ ID NO: 7108 - protein, 560 aa, Triticum aestivum
MLVLFETPAGFALFKVLDEGKLSSVEDLWKDFASSDKARKVVELKAFNKFENTSDALSAATLLIDSKPSKGLRKFLQKHCDGETLAVADSKLGNAIKEKLQIDCLHNSAVMELMRGLRNQLTELMSGLAEHDLGPMSLGLSHSLSRYKLKFSPEKVDTMIIQAIGLLDDLDKELNTYAMRVREWYGWHFPELTKIVADNIHYAKAVKMMGNRVNAVNLDFSEILPEEVEAELKEAAVISMGTEVNDLDLSNIRELCDQVLALSEYRAQLYDYLKSRMNTIAPNLTALVGELVGARLISHGGSLMNLAKQPGSTIQILGAEKALFRALKTKHATPKYGLIYHASLIGQAAPKHKGKISRSLAAKSALAIRYDALADGDDNSMGLESRIKLETRLRVLEGKELGRSAGSTKGKPKIEAYEKDRKGGGALITPAKTYNSAADLVLGQTTEETPKKSEVASKKRKHQEEEPTAEAAEEDGEQEKEKSKKKKKKSKDIEETPAAVTDASEKKKKKKSKEAEETPAADADGEKKKKKKKLDAEDAPMEIDVSAKKEKKKKKKHADE

SEQ ID NO: 7109 - protein, 558 aa, Avena sativa
MLVLFETPAGFALFKVLDEGKLSKVEDLWKDFASSDKARKVVELKAFNKFENTSDALSAATLLIDSKPSKGLRKFLSKHCDGETLAVADSKLGNAIKEKLKIDCLHNSAVMELMRGLRNQLTELMSGLAEHDLGPMSLGLSHSLSRYKLKFSPEKVDTMIIQAIGLLDDLDKELNTYAMRVREWYGWHFPELTKIVADNIHYAKAVKLMGNRVNAVNIDFSEILEEDVEAELKEAAVISMGTEVNDLDLSNIRELCDQVLSLSEYRAQLYDYLKSRMNTIAPNLTALVGELVGARLIAHGGSLMNLAKQPGSTIQILGAEKALFRALKTKHATPKYGLIYHASLIGQAAPKHKGKISRSLAAKTALAIRYDALADGDDNSMGLESRIKLETRLRVLEGKELGKSAGSTKGKPKIEAYEKDRKGAGALITPAKTYNPAADLVLSTEETPKKSEVASKKRKHEDAEPTKETVAEDGEQEKEKSKKKKKKSKDAEESPAVEADSGEKKKKKKSKESEEVPPPSADADGEKKKKKKKSDTEDAAAPMETDASAKKDKKKKKK

SEQ ID NO: 7110 - protein, 557 aa, Hordeum vulgare
MLVLFETPAGFALFKVLDEGKLSSVEDLWKDFASSDKARKVVELKAFNKFENTSDALSAATLLIDSKPSKGLRKFLQKHCDGETLAVADSKLGNAIKEKLKIDCLHNSAVMELMRGLRNQLTELMSGLAEHDLGPMSLGLSHSLSRYKLKFSPEKVDTMIIQAIGLLDDLDKELNTYAMRVREWYGWHFPELTKIVADNIHYAKAVKMMGNRVNAVNLDFSEILPEEVEAELKEAAVISMGTEVNELDLSNIRELCDQVLALSEYRAQLYDYLKSRMNTIAPNLTALVGELVGARLIAHGGSLMNLAKQPGSTIQILGAEKALFRALKTKHATPKYGLIYHASLIGQAAPKHKGKISRSLAAKSALAIRYDALADGDDNSMGLESRIKLETRLRVLEGKDLGRSAGSTKGKPKIEAYEKDRKGGGALITPAKTYNPAADLVVGQTTEETPKKEVASKKRKHQEEEPTVEAAEKDGEQEKEKSKKKKKKSKDTEETPAADADASEKKKKKKSKEAEETPAADADGEKKKKKKKSDAEDTPMETDVSAKKKKKKKHADE

SEQ ID NO: 7111 - protein, 560 aa, Triticum aestivum
MLVLFETPAGFALFKVLDEGKLSSVEDLWKDFASSDKARKVVELKAFNKFENTSDALSAATLLIDSKPSKGLRKFLQKHCDGETLAVADSKLGNAIKEKLQIDCLHNSAVMELMRGLRNQLTELMSGLAEHDLGPMSLGLSHSLSRYKLKFSPEKVDTMIIQAIGLLDDLDKELNTYAMRVREWYGWHFPELTKIVADNIHYAKAVKMMGNRVNAVNLDFSEILPEEVEAELKEAAVISMGTEVNDLDLSNIRELCDQVLALSEYRAQLYDYLKSRMNTIAPNLTALVGELVGARLISHGGSLMNLAKQPGSTIQILGAEKALFRALKTKHATPKYGLIYHASLIGQAAPKHKGKISRSLAAKSALAIRYDALADGDDNSMGLESRIKLETRLRVLEGKELGRSAGSTKGKPKIEAYEKDRKGGGALITPAKTYNSAADLVLGQTTEETPKKSEVASKKRKHQEEEPTAEAAEQDGEQEKEKSKKKKKKSKDIEETPAAVTDASEKKKKKKSKEAEDTPAANTDGEKKKKKKKSDAEDAPMEVDVSAKKEKKKKKKHADE

SEQ ID NO: 7112 - protein, 167 aa, Saccharum officinarum
MTELFDTAVTSLLHLPEVLDRLAAADGDRRSGGHHAAHHHGHARVHGLGGGAPVDIMETPGEYTFVLDVPGLSKSDIQVTLEEDRVLVMKGGNGKRKREEEEEGEGCRYIRLERGAAPRSFARKFRLPEDADTGGVAARCENGVLTVTVKKLPPPDKTTKSVQVIIA

SEQ ID NO: 7113 - protein, 171 aa, Zea mays
MTELFDTAVTSLLHLPEVLDRLAAADGDRRSAGHHAAHGHGHGRVHGLGGGGGAPVDIVESPREYAFVLDVPGLSKSDIQVTLEEDRVLVMKGGSGKRKRDEEEDMNGEGCRYIRLERGAAPRSFVRKFRLPEDADTGGVAARCENGVLTVTVKKLPPPEKKAKTVQVTIA

SEQ ID NO: 7114 - protein, 179 aa, Panicum virgatum
MTELFDTAVTSLLHLPEVLDRLAAADGDRRSGGHHGAHHHGHARVHGLGAGAGGAPVDIVETPGEYTFLLDVPGLSKSDIQVTLEEDRVLVMKGGSSSNSNNNNGKRKREEEEEEGEGCRYIRLERRASPRSFVRKFRLPEDADAGGIAARCENGVLTVTVKKQPPPEKKTKSVQVTIA

SEQ ID NO: 7115 - protein, 174 aa, Cenchrus ciliaris
  misc_feature (71)..(73): Xaa can be any naturally occurring amino acid
MTELFDTAVTSLLHLPEVLDRLAAADGDRRSGGHHGAHHHGHARVHGLGGGGGGAPVDIVETPGEYSFLLXXXGLSKSDIQVTLEEEDRVLVMKGGNNGGKRKRDEEEEDGEGCRYIRLERRAAPRSFVRKFRLPEDADTGGIAARCENGVLTVTVKKQPPPEKTTKSVQVTIA

SEQ ID NO: 7116 - protein, 178 aa, Panicum virgatum
MTELFDTAVTSLLHLPEVLDRLAAADGDRRSGGHHGAHHHGRHARVHGLGTGAGGAPVDIVETPGEYTFLLDVPGLSKSDIQVTLEEDRVLVMKGGGGGSSNNNNGKRKREEEEGEGCRYICLERRASPRSFVRKFRLPEDADVGGIAARCENGVLTVTVKKQPPPEKKTKSVQVTIA

SEQ ID NO: 7117 - protein, 172 aa, Oryza sativa
MTELFDTAVTSLLHLPEVLDRLGAAAGDRRSAGDHAHHAAHGHGQHRISGIGGGAPVDIMETPGEYAFVLDVPGLSKSDIQVTLEEDRVLVMKSSNGAGNGKRKREEEEGECKYIRLERRASPRAFARKFRLPEDADTGGISARCENGVLTVTVKKRPPPEKKTKSVQVTIA

SEQ ID NO: 7118 - protein, 686 aa, Sorghum bicolor
YAKHKHLQVDPPPAKLAENEEVTEDIILAALRRALAQHSSLQADDGCWPADYSGLLFIMPLLVFALYTTGSLNTVLSKEHQREIRRYIYNHQAYGGWGKQVLGPSTMFGSCLNYVALRLIGEDCTNVALTNGREWILSHGSATAIPQWGKIWFSVMGLYDWSGNNPVIPELWLLPYFLPIHPGRFWILCRMVYLPMAYLFGKKFVGEVTPTILELRSELYSVPYSEVDWKKARDTCAKVDLIYPRTMAQNLVWTFLNKVIEPMLNWWPVNKLRDIALQNIMEHIHYEDETSKYICICPINKALDMICCWAENPNSDAFKQHLPRIYDMLWLAEDGMKAQVYDGCTTWETAFIVQAFCSTGLVNEISSTLRKAHEFIKCSQISENHLDYKSYYRHASKGSWTLSTADNGCSISDCTAEALKALLLLSKISPDLVGEPIKGESLYDAVDCLLSFVNNDGSFSAYECKRTTPLLEVLNPSESFRNIIVDYPCVECTSSVLQALIMFRDLDHVYRKEEIGNCIERASRFIEKEQRKDGSWFGSWGICFTYGTFFAIKGLALSGRTYENSDAIRKACSFLLSKQLHTGGWGETYLSSETAEYVEASRPHAVNTAWAMLTLVYGGQVERDPTPLYKAAKELINMQLDSGDFPQQEHVGCFNSSIFFNYGNYRNLYPIWALGEFRRRLLERKK

SEQ ID NO: 7119 - protein, 445 aa, Zea mays
MGRRLSATAAAAAASAEPLLPPALKRGVLIERCASHADDELQWFRSCLRWVCMDHSGPGQAALSWLLFLVLAAIVPAAAHFLLAFRASRRPFSAVVQLSLSAASAAGFLCLSSSFRRVGLRRLLHLDKLRSKSDRVRASYTARLAFSFRLLASLVAPCFAAEAAYKAWWYATSADRVPFFANDVLSDVLVCSLEMASWMYRSAIYLLTCVLFRLICHLQGLRLEDFAGSLLEEVEEGRAGVDAVLREHLDIRKQLKVISHRFRKFIVAALLIATASQFASVLLTTRRDSVDDLLNTGELALCSVVLMSGLIIILSSAAKITHQAQALTGHTTKWHACCTIEPVLEEGEPGSNQNSMIDQEPESDSDTEDSEETGDEDLLENTKIHMPHAHVISFQKRQALVTYLENNRAGITVFGFTLDRSYLHTIFMLEWTLFLWLLGKTIGFS

SEQ ID NO: 7120 - protein, 447 aa, Pennisetum glaucum
MGRRPTAANAAAVASAEPLLPSALKRGVAMERCASRADDELQWFRSCLRWVCMDHSGPFQSALSWLLFLALTVLVPAAAHFLLAFRASRRPFSAVVQLSLSAASAAGFLCLSSSFRRIGLRRLLYLDKLRTKSDRVRIHYTARLAFSFRLLASLVAPCFAAEAAYKAWWYATSADRVPFFANDVLSDVLACSLEMASWMYRSAVYLLTCVLFRLICHLQGLRLEDFAGSLLEDVEEGRVGVDSVLREHLDIRKQLKVISHRFRKFIVAALLIATASQFAAVLLTTRHDSVDDLFNTGELALCSVVLMSGLIIILSSAAKITHQAQALTGHTTKWHACCTIAPVEDEEGEPGSNQNSMIEQDPSSDSDTESGDYTGDDEDLLENTKIHLPHVHVISFQKRQALVTYLENNRAGITVFGFTLDRSYLHTIFMLEWTLFLWLLGKTIGFS

SEQ ID NO: 7121 - protein, 284 aa, Setaria italica
MGRRPSASNAAAVASAEPLLPSALKRGVMERCASRPDDELHWFRSCLRWVCMDHSGPCQSALSWLLFLALSVVVPAAAHFLLAFRASRRPISAVVQLSLSAASAAGFLCLSSSFRRIGLRRLLYLDKLRTKSDRVRFHYTARLAFSFRLLASLVAPCFVAEAAYKAWWYATSADRVPFFANDVLSDVLACSLEMASWMYRSAVYLLTCVLFRLICHLQGLRLEDFAGSLLEDGGAHRRRQRPQGAPRHPQAAQGHQPQVQEVHRRRPAHHHRQPVRIRAPHHAT

SEQ ID NO: 7122 - protein, 452 aa, Oryza sativa
MGRRSSASSAAAGEPLLPAAASAKGGGGGGGRASMLQRCVSRADDELQWFRSCLRWVCMDHSGPWGAALSWLLFLLLAVAVPAAAHFLLAFRASRRPFSAVVQVSLSAASAAGFLCLSSSFRRIGLRRLLYLDKLRTKSDRVRLNYTARLSFSFRLLASLVAPCFAAEAAYKVWWYATSGDRVPFFGNDVLSNAVACSVEMAAWMYRSAIYLLTCVLFRLICHLQGLRLEDFAGTLLVEVEEGRAGVERVLREHLDIRKQLKVISHRFRKFIVASLLIATASQFASLLLTTRHDSVDDLLNTSELALCSVVLMSGLIIILSSAAKITHQAQALTGQTTKWHACCTIEPVPDEEAEPGSNHSSMLEVEPVSDSDGESSEETGDEDLLENTKIMLPQAHVISFQKRQALVTYLENNRAGITVFGFTLDRSYLHTIFMLEWTLFLWLLGKTIGFS

SEQ ID NO: 7123 - protein, 444 aa, Avena sativa
MGRRSNASPAEPLLPEMLKGGGRGAMLQRTMSRADDELQWFRSCLRWVCMDHSAPGGAALSWLLFILLAVVVPAIAHFLLAFRPSRRPFDAVVQLSLSAASGASFLCLSSSFRRIGLRRLLYLDKLQTKSDRVRVNYTARLAFSFRLLASLVAPCFAAEAAYKAWWYATSADRVPFFANDVLSDVLAYSLEMASWMYRSAIYLLTCVLFRLICHLQGLRLEDFAGSLLVEVEEGRMGVERVLKEHLDIRKQLKVISHRFRRFIVAALLIATASQFASVLLTTRRDSIDDVLHTGELALCSVVLMSGLTIILSSAAKITHQAQALTGQTTKWHACCTIEPVPDNELDPGSNQNSMTEEYAAETESDCESSEETGDEDMLENTRFMQPHSHVISFQKRQALVTYLENNKAGITVFGFTLDRSYLHTIFMLEWTLFLWLLGKTIGFS

SEQ ID NO: 7124 - protein, 139 aa, Setaria italica
MKDSRTSSPGAYPSAAARLRQMQAATSSNREHRMPGGARWRSPAISRVPKKKGTRAMSAGGVDSILSGPPAGSRYSRCGYDGAMNNSLPHAGATDGAAAPHASSQTAFSNCIPPGASTTQWQNRCPKMKPPHLSRVTWM

SEQ ID NO: 7125 - protein, 448 aa, Zea mays
MASSLPAFTVRRGDPVLVAPAGPTPRETKPLSDIDDAEGMRFYSSGIHLYRANPAKAGQDPARVIRDALARALVPYYPLAGRLREVEGRKLVVDCAAQGVMFAEADADGLTAADFGDVQSPPFPCFEQFILESTTVAGVEPVVDRPLLYVQVTRLRCGGFIFGQRFCHCVVDAPGGMQFEKAVCEVACGAAAPSVAPAWGREMFMARDPPRPAYPHLEYREPAGGPADRMLCTAPADMARVPFFFGPREIAGLRQRAPPGARCSRFELVAACIWRSRTAALGYAADQEVRLSFIVNARGRPDIPLPEGFYGNAFAYSVAAATAGELCAGDLGFALDLVRKAKTAVTYDYLLSVADLMVLTGRPLFAVSRTYIVSDVSHAGFKSVDFGWGEAVYGGPAKGGEGPLLGVTNYFSRAKNGKGEEGTVVPICLPKDAMEKFQLEVEGLTAEL

SEQ ID NO: 7126 - protein, 444 aa, Saccharum officinarum
MASSLPAFTVRRGDPVLVAPSAPTPRETKPLSDIDDSEGMRFYSSGIHLYRANPAKAGQDPARVIREALAQALVPYYPLAGRLREVEGRKLVVDCTGQGILFAEADADLTADDFGDVQSPPFPCFEQFILESTTVAGVEPVVDRPLLYVQVTRLKCGGFIFGQRFCHCIVDAPGGMQFEKAVCEMACGAAAPSVEPAWGREMFMARNPPRPAYPHIEYREPAGGVGVDRMLTTPAADMARVPFFFGAREIAGLRQRAPPGMRCSRFELVAACIWRSRTAALGYAPDEEVRLSFIVNARGRPDIPLPEGFYGNAFAYSVAATTAGELCGGDLGFTLELVKKAKSAVTYDYLLSVADLMVLTGRPLFEVSRTYIVSDVSHAGFKSVDFGWGEAVYGGPAKGGDRPLPGVTNYFSRANNGKGGEGTVVPICLPKDALEKFQPRGGRP

SEQ ID NO: 7127 - protein, 450 aa, Oryza sativa
MASSPLPAFTVRRGEPVLVTPAAPTPREVKALSDIDDGEGMRFYSSGIHLYRNNPAKKGQDPAMVIREALARALVPYYPLAGRLREEAGRKLVVECAGQGVMFAEADADLTADDFGDVQSPPFPCFERFILESTTVAGVEPVVGRPLLYIQVTRLRCGGFIFGQRFCHCVVDAPGGMQFEKAVCELARGAAAPSVSPSWGREMFMARDPPRPSYPHLEYREPAGGADRLLATPPEDMVRVPFFFGPREIAGLRQHAPASVRGACSRFELVAACIWRSRTAALGYAPGEEVRLSFIVNARGRADVPLPEGFYGNAFAYSVAATTAGELCGGDLGYALGLVKKAKSAVTYEYLQSVADLMVVAGRPLFALSRTYIVSDVSHAGFKSVDFGWGEAVYGGPAKGGEGPLLGVTNYFSRSKNGKGEQSVVVPICLPKDAMDKFQLEVQALTAELS

SEQ ID NO: 7128 - protein, 453 aa, Brachypodium distachyon
MASSLLPAFTVRRGEPVLVSPSAPTPRETKPLSDIDDGEGMRFYSSGIHLYRANPDKRGQDPAAVIREALAKALVLYYPLAGRLKEEAGRKLVVECGAQGVMFVEAEADLTAADFGDVQSPPFPCFEQFILESTTVAGVEPVIDRPLLYIQVTRLKCGGFIFGQRFCHCVVDAPGGMQFEKAICELARGAATPSITPSWGREMFMARQQQQPSYPHLEYSEPSGGGPEPDRMLTTPASDMSRVPFFFGPNEIAGLRQRAPPHMRGATSRFELVAACVWLCRTAALGYGADEEVRLSFIVNARGRKDVPLPEGFYGNAFAYSVAAATAGELCAGGMGFALELVKKAKSAVTYDYLLSVADLMVSRGRPLFALTRTYIVSDVSHAGFKSVDFGWGEPLYGGPAKGGEGPLPGVTNYFSRSKNGKGEEGTVVPVCLPKDAMEKFQLEVQGLTAQQL

SEQ ID NO: 7129 - protein, 82 aa, Helianthus annuus
MYPEMVSGESTNNETLILGVAPTETGIETTGGVATAAENEGCKCNPCTCNPCTCKSVMGMPTMECHRSYVTLLKLAKHPWIP

SEQ ID NO: 7130 - protein, 79 aa, Parthenium argentatum
MSSSCCGENCGCGSGCKCGNGCGGCKMYPDVSGESTTTETLILGVAPTKTGVETHEGVAAAENGGCKCNPCTCNPCTCK

SEQ ID NO: 7131 - DNA, 31 bp, Artificial Sequence
  Single strand DNA oligonucleotide
aaaggatcctgattgtgatttacgaccttgc

SEQ ID NO: 7132 - DNA, 26 bp, Artificial Sequence
  Single strand DNA oligonucleotide
aaagtcgaccggagcgcctcactgct

SEQ ID NO: 7133 - DNA, 31 bp, Artificial Sequence
  Single strand DNA oligonucleotide
aaaggatcctctcgcagagataaggagaagc

SEQ ID NO: 7134 - DNA, 33 bp, Artificial Sequence
  Single strand DNA oligonucleotide
aaagtcgactgtctttcaagtgaaaatggcttc

SEQ ID NO: 7135 - DNA, 31 bp, Artificial Sequence
  Single strand DNA oligonucleotide
aaagtcgacaaagaaagttggtcacgaggag

SEQ ID NO: 7136 - DNA, 36 bp, Artificial Sequence
  Single strand DNA oligonucleotide
aaaggatccaataaagtcactatgaaaaacacatca

SEQ ID NO: 7137 - DNA, 32 bp, Artificial Sequence
  Single strand DNA oligonucleotide
aaaggatcctccttgacttatttgaaagctgc

SEQ ID NO: 7138 - DNA, 31 bp, Artificial Sequence
  Single strand DNA oligonucleotide
aaaggatccctaaatttgctcggttctcacc

SEQ ID NO: 7139 - DNA, 33 bp, Artificial Sequence
  Single strand DNA oligonucleotide
aaaggatccttaagtctatccacattctcgtcg

SEQ ID NO: 7140 - DNA, 31 bp, Artificial Sequence
  Single strand DNA oligonucleotide
aaagtcgacgcatggatgcttctcttctttc

SEQ ID NO: 7141 - DNA, 27 bp, Artificial Sequence
  Single strand DNA oligonucleotide
aaactcgagctccgccacacaaactcc

SEQ ID NO: 7142 - DNA, 31 bp, Artificial Sequence
  Single strand DNA oligonucleotide
aaaggatccatcgagagtcacatcggctatc

SEQ ID NO: 7143 - DNA, 34 bp, Artificial Sequence
  Single strand DNA oligonucleotide
tttggatcccgaagtgatggctagaatttacaac

SEQ ID NO: 7144 - DNA, 33 bp, Artificial Sequence
  Single strand DNA oligonucleotide
aaaggatccccagaaactgttaactaatggctg

SEQ ID NO: 7145 - DNA, 36 bp, Artificial Sequence
  Single strand DNA oligonucleotide
aaaggatcccacctttactattactcaaatttctcc

SEQ ID NO: 7146 - DNA, 34 bp, Artificial Sequence
  Single strand DNA oligonucleotide
aaaggatcccaggtaacattctactgtaccgagc

SEQ ID NO: 7147 - DNA, 26 bp, Artificial Sequence
  Single strand DNA oligonucleotide
tttggatcccgagcgacctttcccca

SEQ ID NO: 7148 - DNA, 30 bp, Artificial Sequence
  Single strand DNA oligonucleotide
aaagatatcctcctccgatccaaaatcatc

SEQ ID NO: 7149 - DNA, 28 bp, Artificial Sequence
  Single strand DNA oligonucleotide
aaaggatcctagccaccgtcactcttcg

SEQ ID NO: 7150 - DNA, 27 bp, Artificial Sequence
  Single strand DNA oligonucleotide
aaaggatccggtgattgttgcccatcc

SEQ ID NO: 7151 - DNA, 28 bp, Artificial Sequence
  Single strand DNA oligonucleotide
aaaggatccagcgacttcatccctccac

SEQ ID NO: 7152 - DNA, 27 bp, Artificial Sequence
  Single strand DNA oligonucleotide
aaaggatcccagctgccagcgaggtag

SEQ ID NO: 7153 - DNA, 31 bp, Artificial Sequence
  Single strand DNA oligonucleotide
aaaggatccgcattaatagagctcagcgacc

SEQ ID NO: 7154 - DNA, 27 bp, Artificial Sequence
  Single strand DNA oligonucleotide
aaaggatcccgagagccatcatcccac

SEQ ID NO: 7155 - DNA, 31 bp, Artificial Sequence
  Single strand DNA oligonucleotide
aaaggatccccgcattgacggatagagatag

SEQ ID NO: 7156 - DNA, 27 bp, Artificial Sequence
  Single strand DNA oligonucleotide
aaaggatccatcaaacgccctgctcac

SEQ ID NO: 7157 - DNA, 31 bp, Artificial Sequence
  Single strand DNA oligonucleotide
aaagtcgacggcgacgaataagtagcaaatc

SEQ ID NO: 7158 - DNA, 30 bp, Artificial Sequence
  Single strand DNA oligonucleotide
aaaggatccatccaattcaatccgtcttcc

SEQ ID NO: 7159 - DNA, 34 bp, Artificial Sequence
  Single strand DNA oligonucleotide
aaaggatcccagcaatcgatccatctaaactagg

SEQ ID NO: 7160 - DNA, 31 bp, Artificial Sequence
  Single strand DNA oligonucleotide
aaagtcgactccgataccaaagctcatcttc

SEQ ID NO: 7161 - DNA, 26 bp, Artificial Sequence
  Single strand DNA oligonucleotide
tttgtcgaccggcccatccatccatc

SEQ ID NO: 7162 - DNA, 28 bp, Artificial Sequence
  Single strand DNA oligonucleotide
aaagtcgacacaagtctctgcacggctg

SEQ ID NO: 7163 - DNA, 31 bp, Artificial Sequence
  Single strand DNA oligonucleotide
aaagtcgacaaaccctcgtctctgattctcc

SEQ ID NO: 7164 - DNA, 30 bp, Artificial Sequence
  Single strand DNA oligonucleotide
tttggatccgaaggagatggagctggtgtc

SEQ ID NO: 7165 - DNA, 28 bp, Artificial Sequence
  Single strand DNA oligonucleotide
aaaggatccccttctcccgagcaagaac

SEQ ID NO: 7166 - DNA, 31 bp, Artificial Sequence
  Single strand DNA oligonucleotide
aaaggatccgcaccagcacctttactagacc

SEQ ID NO: 7167 - DNA, 31 bp, Artificial Sequence
  Single strand DNA oligonucleotide
aaaggatcctgagctttgcatttggtgttag

SEQ ID NO: 7168 - DNA, 27 bp, Artificial Sequence
  Single strand DNA oligonucleotide
aaaggatcctcccatcctccgtcaaag

SEQ ID NO: 7169 - DNA, 27 bp, Artificial Sequence
  Single strand DNA oligonucleotide
aaaggatccgctctcacccgctacacc

SEQ ID NO: 7170 - DNA, 28 bp, Artificial Sequence
  Single strand DNA oligonucleotide
aaaggatccgcagcaccacctacctcac

SEQ ID NO: 7171 - DNA, 31 bp, Artificial Sequence
  Single strand DNA oligonucleotide
aaaggatccggacacccacacaagaacaaac

SEQ ID NO: 7172 - DNA, 32 bp, Artificial Sequence
  Single strand DNA oligonucleotide
aaactcgagtgggtttagtagggtttggactc

SEQ ID NO: 7173 - DNA, 30 bp, Artificial Sequence
  Single strand DNA oligonucleotide
aaaggatcctcagttctagcctcccagtcc

SEQ ID NO: 7174 - DNA, 29 bp, Artificial Sequence
  Single strand DNA oligonucleotide
aaaggatccagagagaaaccgccaaatcc

SEQ ID NO: 7175 - DNA, 27 bp, Artificial Sequence
  Single strand DNA oligonucleotide
aaagtcgacaaatggccggatagctcc

SEQ ID NO: 7176 - DNA, 30 bp, Artificial Sequence
  Single strand DNA oligonucleotide
aaagtcgacaaacatcaccaacaaacctgc

SEQ ID NO: 7177 - DNA, 28 bp, Artificial Sequence
  Single strand DNA oligonucleotide
aaaggatcccccaagtgtaacacgcacg

SEQ ID NO: 7178 - DNA, 27 bp, Artificial Sequence
  Single strand DNA oligonucleotide
tttggatccccgagcatcgaccatgtc

SEQ ID NO: 7179 - DNA, 36 bp, Artificial Sequence
  Single strand DNA oligonucleotide
aaaggatcccagactcctagctctagctctctcttc

SEQ ID NO: 7180 - DNA, 33 bp, Artificial Sequence
  Single strand DNA oligonucleotide
aaactcgaggaaacatctaaaccctccttctcc

SEQ ID NO: 7181 - DNA, 31 bp, Artificial Sequence
  Single strand DNA oligonucleotide
aaaggatccttctcgtttcccatatcctacc

SEQ ID NO: 7182 - DNA, 28 bp, Artificial Sequence
  Single strand DNA oligonucleotide
aaaggatcccatacgtacgtgcccaagc

SEQ ID NO: 7183 - DNA, 26 bp, Artificial Sequence
  Single strand DNA oligonucleotide
acaggatccaatttcaggcggcgaca

SEQ ID NO: 7184 - DNA, 30 bp, Artificial Sequence
  Single strand DNA oligonucleotide
aaaggatccagctgagagagcacagagcac

SEQ ID NO: 7185 - DNA, 29 bp, Artificial Sequence
  Single strand DNA oligonucleotide
aaaggatcccggatttcacactcctcctc

SEQ ID NO: 7186 - DNA, 29 bp, Artificial Sequence
  Single strand DNA oligonucleotide
aaaggatccagggaaatgagcagcgagac

SEQ ID NO: 7187 - DNA, 30 bp, Artificial Sequence
  Single strand DNA oligonucleotide
aaaggatcctaagccctagaacaccccttg

SEQ ID NO: 7188 - DNA, 33 bp, Artificial Sequence
  Single strand DNA oligonucleotide
aaaggatccctacagtcctttgtctctgccttc

SEQ ID NO: 7189 - DNA, 29 bp, Artificial Sequence
  Single strand DNA oligonucleotide
aaaggatccaggcgtagaaccctctccag

SEQ ID NO: 7190 - DNA, 27 bp, Artificial Sequence
  Single strand DNA oligonucleotide
aaagtcgacgcacgaaaggaacgaagc

SEQ ID NO: 7191 - DNA, 31 bp, Artificial Sequence
  Single strand DNA oligonucleotide
aaaggatcccatctttatccgaatcggtagc

SEQ ID NO: 7192 - DNA, 29 bp, Artificial Sequence
  Single strand DNA oligonucleotide
aaaggatccacttccctgttccacgtctg

SEQ ID NO: 7193 - DNA, 27 bp, Artificial Sequence
  Single strand DNA oligonucleotide
tttgtcgacccaccatgtacggcgtca

SEQ ID NO: 7194 - DNA, 29 bp, Artificial Sequence
  Single strand DNA oligonucleotide
aaaggatccccagatcccctctcttctcc

SEQ ID NO: 7195 - DNA, 34 bp, Artificial Sequence
  Single strand DNA oligonucleotide
aaaggatccaattccaatctttcccttcttcttc

SEQ ID NO: 7196 - DNA, 34 bp, Artificial Sequence
  Single strand DNA oligonucleotide
aaaggatcctgaaaatggctgctaccttctttag

SEQ ID NO: 7197 - DNA, 32 bp, Artificial Sequence
  Single strand DNA oligonucleotide
aaagtcgacttcatttctttaggagggtggtc

SEQ ID NO: 7198 - DNA, 34 bp, Artificial Sequence
  Single strand DNA oligonucleotide
aaagtcgacgaagtttgaagaatcaaggagagtg

SEQ ID NO: 7199 - DNA, 32 bp, Artificial Sequence
  Single strand DNA oligonucleotide
aaaggatcctctttctgactcagttccgtctc

SEQ ID NO: 7200 - DNA, 30 bp, Artificial Sequence
  Single strand DNA oligonucleotide
aaagtcgaccagcatgtgtctcatcgattc

SEQ ID NO: 7201 - DNA, 29 bp, Artificial Sequence
  Single strand DNA oligonucleotide
aaactcgagcgaggatgatttcttcctgg

SEQ ID NO: 7202 - DNA, 30 bp, Artificial Sequence
  Single strand DNA oligonucleotide
aaaggatccctaaaggaccatggcagtgac

SEQ ID NO: 7203 - DNA, 35 bp, Artificial Sequence
  Single strand DNA oligonucleotide
aaaggatccaaaacttctgttgttgtcttcaatgg

SEQ ID NO: 7204 - DNA, 31 bp, Artificial Sequence
  Single strand DNA oligonucleotide
aaaggatcctcttctcaacaggttctgatgc

SEQ ID NO: 7205 - DNA, 32 bp, Artificial Sequence
  Single strand DNA oligonucleotide
aaagtcgactggatagctggatatcaaagagg

SEQ ID NO: 7206 - DNA, 35 bp, Artificial Sequence
  Single strand DNA oligonucleotide
aaaggatccaatacgagagtgaaagcaatgaaatc

SEQ ID NO: 7207 - DNA, 30 bp, Artificial Sequence
  Single strand DNA oligonucleotide
aaaggatccatttaacccaatcaacgctgc

SEQ ID NO: 7208 - DNA, 31 bp, Artificial Sequence
  Single strand DNA oligonucleotide
aaaggatccaagctgtttcgtctttcacgtc

SEQ ID NO: 7209 - DNA, 34 bp, Artificial Sequence
  Single strand DNA oligonucleotide
aaaggatccagttctcaactctctcaaattcacc

SEQ ID NO: 7210 - DNA, 31 bp, Artificial Sequence
  Single strand DNA oligonucleotide
aaagtcgactattacgactcagcagtccgag

SEQ ID NO: 7211 - DNA, 32 bp, Artificial Sequence
  Single strand DNA oligonucleotide
aaaggatccaatgctctcaagtcccttcattc

SEQ ID NO: 7212 - DNA, 32 bp, Artificial Sequence
  Single strand DNA oligonucleotide
aaaggatcctctgattgtatttctccagcagc

SEQ ID NO: 7213 - DNA, 32 bp, Artificial Sequence
  Single strand DNA oligonucleotide
aaagtcgactcacagatacacaccacgctaag

SEQ ID NO: 7214 - DNA, 32 bp, Artificial Sequence
  Single strand DNA oligonucleotide
aaagatatcgccgctgctcatataaggtactg

SEQ ID NO: 7215 - DNA, 30 bp, Artificial Sequence
  Single strand DNA oligonucleotide
aaaggatcctatacgccacacagatggctc

SEQ ID NO: 7216 - DNA, 32 bp, Artificial Sequence
  Single strand DNA oligonucleotide
aaaggatccttgattgatttatccaaagcagc

SEQ ID NO: 7217 - DNA, 31 bp, Artificial Sequence
  Single strand DNA oligonucleotide
aaagtcgacttgccaatcacccgataataag

SEQ ID NO: 7218 - DNA, 31 bp, Artificial Sequence
  Single strand DNA oligonucleotide
aaaggatccacaagtcgtcttcttctccgtc

SEQ ID NO: 7219 - DNA, 29 bp, Artificial Sequence
  Single strand DNA oligonucleotide
aaaggatccgtaggccgatagccaaccag

SEQ ID NO: 7220 - DNA, 31 bp, Artificial Sequence
  Single strand DNA oligonucleotide
aaaggatccagtcgtctttctccttgaccag

SEQ ID NO: 7221 - DNA, 35 bp, Artificial Sequence
  Single strand DNA oligonucleotide
aaagtcgacacgtctttggtaaagttctctctctc

SEQ ID NO: 7222 - DNA, 32 bp, Artificial Sequence
  Single strand DNA oligonucleotide
aaagtcgactatagtttcaagcacaacgctgc

SEQ ID NO: 7223 - DNA, 29 bp, Artificial Sequence
  Single strand DNA oligonucleotide
aaaggatccgtaaccctgcattgcacatc

SEQ ID NO: 7224 - DNA, 31 bp, Artificial Sequence
  Single strand DNA oligonucleotide
aaaggatccatgaacccaagccacatcttag

SEQ ID NO: 7225 - DNA, 31 bp, Artificial Sequence
  Single strand DNA oligonucleotide
aaactcgagatttcttgcttgacgagctgag

SEQ ID NO: 7226 - DNA, 31 bp, Artificial Sequence
  Single strand DNA oligonucleotide
aaaggatccaccacgactcgctcagtttatg

SEQ ID NO: 7227 - DNA, 29 bp, Artificial Sequence
  Single strand DNA oligonucleotide
aaaggatccaaacgcaagcaacgaatctc

SEQ ID NO: 7228 - DNA, 31 bp, Artificial Sequence
  Single strand DNA oligonucleotide
aaaggatccaaatcaactctgccatttcgtc

SEQ ID NO: 7229 - DNA, 31 bp, Artificial Sequence
  Single strand DNA oligonucleotide
aaaggatccactgcaaacctctgcaaatacc

SEQ ID NO: 7230 - DNA, 31 bp, Artificial Sequence
  Single strand DNA oligonucleotide
aaaggatccctaaactcggccatacatgcac

SEQ ID NO: 7231 - DNA, 31 bp, Artificial Sequence
  Single strand DNA oligonucleotide
aaagtcgaccttcctatcattctgggaatcg

SEQ ID NO: 7232 - DNA, 34 bp, Artificial Sequence
  Single strand DNA oligonucleotide
aaaggatccgcttcttcttatgttcatccaaatc

SEQ ID NO: 7233 - DNA, 31 bp, Artificial Sequence
  Single strand DNA oligonucleotide
aaaggatccacaccacagcaagagctaagtg

SEQ ID NO: 7234 - DNA, 32 bp, Artificial Sequence
  Single strand DNA oligonucleotide
aaaggatccggagaaagttgtgaataccgacc

SEQ ID NO: 7235 - DNA, 32 bp, Artificial Sequence
  Single strand DNA oligonucleotide
aaaggatcctctgctgcagtataaaggaggac

SEQ ID NO: 7236 - DNA, 26 bp, Artificial Sequence
  Single strand DNA oligonucleotide
aaaggatcccctacgatgccgttgcg

SEQ ID NO: 7237 - DNA, 28 bp, Artificial Sequence
  Single strand DNA oligonucleotide
tttgtcgaccggtgggggcgaatggctg

SEQ ID NO: 7238 - DNA, 28 bp, Artificial Sequence
  Single strand DNA oligonucleotide
aaagtcgacaccggaaaccctacccatc

SEQ ID NO: 7239 - DNA, 27 bp, Artificial Sequence
  Single strand DNA oligonucleotide
aaaggatccgaccggatcggagctagg

SEQ ID NO: 7240 - DNA, 30 bp, Artificial Sequence
  Single strand DNA oligonucleotide
aaagtcgacagccagacaagggtcttcatc

SEQ ID NO: 7241 - DNA, 28 bp, Artificial Sequence
  Single strand DNA oligonucleotide
aaaggatccagctttcgtccttgcttgg

SEQ ID NO: 7242 - DNA, 28 bp, Artificial Sequence
  Single strand DNA oligonucleotide
aaaggatccttaccaggctctgctgctg

SEQ ID NO: 7243 - DNA, 30 bp, Artificial Sequence
  Single strand DNA oligonucleotide
aaaggatccacgtgacctcccaaacctaag

SEQ ID NO: 7244 - DNA, 31 bp, Artificial Sequence
  Single strand DNA oligonucleotide
aaaggatccaaatatcctagttgcgtgcgtc

SEQ ID NO: 7245 - DNA, 32 bp, Artificial Sequence
  Single strand DNA oligonucleotide
aaaggatccgtttcctacgtacaagggactgc

SEQ ID NO: 7246 - DNA, 31 bp, Artificial Sequence
  Single strand DNA oligonucleotide
aaagtcgacgggctccatttattcttccttg

SEQ ID NO: 7247 - DNA, 30 bp, Artificial Sequence
  Single strand DNA oligonucleotide
aaaggatccagggagaaggagccgtcttag

SEQ ID NO: 7248 - DNA, 35 bp, Artificial Sequence
  Single strand DNA oligonucleotide
aaaggatccccacaaataaacaccatatatccagc

SEQ ID NO: 7249 - DNA, 30 bp, Artificial Sequence
  Single strand DNA oligonucleotide
aaagaattctgcttcgttcgctctctacac

SEQ ID NO: 7250 - DNA, 31 bp, Artificial Sequence
  Single strand DNA oligonucleotide
aaaggatccgagccatattcgtgtagcttcc

SEQ ID NO: 7251 - DNA, 27 bp, Artificial Sequence
  Single strand DNA oligonucleotide
aaaggatccctgagctccgctgcacac

SEQ ID NO: 7252 - DNA, 28 bp, Artificial Sequence
  Single strand DNA oligonucleotide
aaagtcgacagaggctcagaccgtcagg

SEQ ID NO: 7253 - DNA, 31 bp, Artificial Sequence
  Single strand DNA oligonucleotide
aaaggatcccgtgacaagtttatcatccacc

SEQ ID NO: 7254 - DNA, 28 bp, Artificial Sequence
  Single strand DNA oligonucleotide
aaaggatccacagctcgcttcctcttcc

SEQ ID NO: 7255 - DNA, 32 bp, Artificial Sequence
  Single strand DNA oligonucleotide
aaaggatcccagctaggacaagacctcttcag

SEQ ID NO: 7256 - DNA, 26 bp, Artificial Sequence
  Single strand DNA oligonucleotide
aaagtcgacgcgccatgagcttgttc

SEQ ID NO: 7257 - DNA, 31 bp, Artificial Sequence
  Single strand DNA oligonucleotide
aaaggatccggtaaagagcgagagagctacg

SEQ ID NO: 7258 - DNA, 29 bp, Artificial Sequence
  Single strand DNA oligonucleotide
aaaggatccgactcgtcttcctccggttc

SEQ ID NO: 7259 - DNA, 32 bp, Artificial Sequence
  Single strand DNA oligonucleotide
aaagtcgactggatagatactccctttccctg

SEQ ID NO: 7260 - DNA, 30 bp, Artificial Sequence
  Single strand DNA oligonucleotide
aaaggatccgcctaagggaggtggtatttg

SEQ ID NO: 7261 - DNA, 31 bp, Artificial Sequence
  Single strand DNA oligonucleotide
aaaggatcctcctcctcatcgattctttcac

SEQ ID NO: 7262 - DNA, 31 bp, Artificial Sequence
  Single strand DNA oligonucleotide
aaaggatcccgagctgatcatcattcctttc

SEQ ID NO: 7263 - DNA, 30 bp, Artificial Sequence
  Single strand DNA oligonucleotide
aaaggatccggaggaagtgataatggcgtc

SEQ ID NO: 7264 - DNA, 31 bp, Artificial Sequence
  Single strand DNA oligonucleotide
aaaggatccgaaagccaaaggcatagaaacc

SEQ ID NO: 7265 - DNA, 27 bp, Artificial Sequence
  Single strand DNA oligonucleotide
aaaggatcccgcatacacagccacctg

SEQ ID NO: 7266 - DNA, 30 bp, Artificial Sequence
  Single strand DNA oligonucleotide
aaaggatccagatctcaccaccactccaac

SEQ ID NO: 7267 - DNA, 29 bp, Artificial Sequence
  Single strand DNA oligonucleotide
aaaggatccatttgcaccaccagctcttc

SEQ ID NO: 7268 - DNA, 28 bp, Artificial Sequence
  Single strand DNA oligonucleotide
aaaggatccaccgcaccaaacaaacaag

SEQ ID NO: 7269 - DNA, 27 bp, Artificial Sequence
  Single strand DNA oligonucleotide
aaaggatccttacgcttgggttggcag

SEQ ID NO: 7270 - DNA, 29 bp, Artificial Sequence
  Single strand DNA oligonucleotide
aaaggatcccagtgagtgtcctgctcctg

SEQ ID NO: 7271 - DNA, 28 bp, Artificial Sequence
  Single strand DNA oligonucleotide
aaaggatcccgcatccaacacctaaacc

SEQ ID NO: 7272 - DNA, 31 bp, Artificial Sequence
  Single strand DNA oligonucleotide
aaagtcgacacgtatcacctgtttctccacc

SEQ ID NO: 7273 - DNA, 28 bp, Artificial Sequence
  Single strand DNA oligonucleotide
aaaggatccgccacacaaacctcgtctc

SEQ ID NO: 7274 - DNA, 31 bp, Artificial Sequence
  Single strand DNA oligonucleotide
aaaggatcctatacaaccgacatcgaagagg

SEQ ID NO: 7275 - DNA, 30 bp, Artificial Sequence
  Single strand DNA oligonucleotide
tttgaattcgccactcagttggttctctcc

SEQ ID NO: 7276 - DNA, 31 bp, Artificial Sequence
  Single strand DNA oligonucleotide
aaaggatccagagcacgagatcgtagcagtc

SEQ ID NO: 7277 - DNA, 32 bp, Artificial Sequence
  Single strand DNA oligonucleotide
aaactcgagggcggcaaataagaggaatatag

SEQ ID NO: 7278 - DNA, 31 bp, Artificial Sequence
  Single strand DNA oligonucleotide
aaagtcgaccctagttggagtccgatattgc

SEQ ID NO: 7279 - DNA, 27 bp, Artificial Sequence
  Single strand DNA oligonucleotide
aaaggatccacgtacgcgtgcttctcg

SEQ ID NO: 7280 - DNA, 28 bp, Artificial Sequence
  Single strand DNA oligonucleotide
aaagtcgacgcctcgtttcttctccgtc

SEQ ID NO: 7281 - DNA, 31 bp, Artificial Sequence
  Single strand DNA oligonucleotide
aaagaattcaacttggaagttggaagcagag

SEQ ID NO: 7282 - DNA, 27 bp, Artificial Sequence
  Single strand DNA oligonucleotide
aaaggatccccgaagcaaagacgatgg

SEQ ID NO: 7283 - DNA, 26 bp, Artificial Sequence
  Single strand DNA oligonucleotide
gcaagtaccctgttgatagttgagtc

SEQ ID NO: 7284 - DNA, 22 bp, Artificial Sequence
  Single strand DNA oligonucleotide
aattcacctgatgaggccttac

SEQ ID NO: 7285 - DNA, 30 bp, Artificial Sequence
  Single strand DNA oligonucleotide
aaagtcgacgagaccactagttctcctgcg

SEQ ID NO: 7286 - DNA, 28 bp, Artificial Sequence
  Single strand DNA oligonucleotide
aaaggatccctccctcttgctcagttgg

SEQ ID NO: 7287 - DNA, 31 bp, Artificial Sequence
  Single strand DNA oligonucleotide
aaaggatccaatcaaagacgccatttccttc

SEQ ID NO: 7288 - DNA, 29 bp, Artificial Sequence
  Single strand DNA oligonucleotide
aaaggatccgatagatggcgtcgtcactg

SEQ ID NO: 7289 - DNA, 33 bp, Artificial Sequence
  Single strand DNA oligonucleotide
aaaggatccaacaaatggctagagttccaagag

SEQ ID NO: 7290 - DNA, 31 bp, Artificial Sequence
  Single strand DNA oligonucleotide
aaaggatcccaaataaatccgccattcaaac

SEQ ID NO: 7291 - DNA, 30 bp, Artificial Sequence
  Single strand DNA oligonucleotide
aaaggatccgaaacgatgtcgtcttcttgc

SEQ ID NO: 7292 - DNA, 30 bp, Artificial Sequence
  Single strand DNA oligonucleotide
aaaggatcccgaaaatgcagatcttcgtga

SEQ ID NO: 7293 - DNA, 32 bp, Artificial Sequence
  Single strand DNA oligonucleotide
aaaggatccgaaaaaaatggcaaaatcatttg

SEQ ID NO: 7294 - DNA, 26 bp, Artificial Sequence
  Single strand DNA oligonucleotide
tttgaattccggagatggcgcggtgc

SEQ ID NO: 7295 - DNA, 32 bp, Artificial Sequence
  Single strand DNA oligonucleotide
aaagtcgacaacacacttgtcaccttctctcc

SEQ ID NO: 7296 - DNA, 31 bp, Artificial Sequence
  Single strand DNA oligonucleotide
aaaggatccgattgatttgggattctgttcg

SEQ ID NO: 7297 - DNA, 31 bp, Artificial Sequence
  Single strand DNA oligonucleotide
aaaggatccgtaaagtgcagtggaggtggag

SEQ ID NO: 7298 - DNA, 31 bp, Artificial Sequence
  Single strand DNA oligonucleotide
aaaggatccccgtagtacacaagcacacacc

SEQ ID NO: 7299 - DNA, 32 bp, Artificial Sequence
  Single strand DNA oligonucleotide
aaagtcgacaaacagagcagatcaatggattc

SEQ ID NO: 7300 - DNA, 31 bp, Artificial Sequence
  Single strand DNA oligonucleotide
aaaggtacccatacatgccgaaactgaagag

SEQ ID NO: 7301 - DNA, 29 bp, Artificial Sequence
  Single strand DNA oligonucleotide
aaagaattccaaacgtctcttgcacctgc

SEQ ID NO: 7302 - DNA, 28 bp, Artificial Sequence
  Single strand DNA oligonucleotide
aaaggtaccggttggtgggtcaaagagc

SEQ ID NO: 7303 - DNA, 29 bp, Artificial Sequence
  Single strand DNA oligonucleotide
aaaggatccacacaaggagtcatgccaag

SEQ ID NO: 7304 - DNA, 36 bp, Artificial Sequence
  Single strand DNA oligonucleotide
aaaaggccttgtattagtaaggcagtgtctctcagc

SEQ ID NO: 7305 - DNA, 32 bp, Artificial Sequence
  Single strand DNA oligonucleotide
tttggtaccacagataacagatcttcccttcc

SEQ ID NO: 7306 - DNA, 31 bp, Artificial Sequence
  Single strand DNA oligonucleotide
aaaggtacccaggttcttcaccaacacattc

SEQ ID NO: 7307 - DNA, 32 bp, Artificial Sequence
  Single strand DNA oligonucleotide
aaaggtacccccttattcccaatttaacaacg

SEQ ID NO: 7308 - DNA, 32 bp, Artificial Sequence
  Single strand DNA oligonucleotide
aaaggtaccttgaaatcaaatcatccacacag

SEQ ID NO: 7309 - DNA, 35 bp, Artificial Sequence
  Single strand DNA oligonucleotide
aaaggatccctacttacacaagtttcaacagcgac

SEQ ID NO: 7310 - DNA, 31 bp, Artificial Sequence
  Single strand DNA oligonucleotide
aaagaattccggagctacactacactgcatc

SEQ ID NO: 7311 - DNA, 29 bp, Artificial Sequence
  Single strand DNA oligonucleotide
aaaggtaccacctcatctccagccaagtg

SEQ ID NO: 7312 - DNA, 34 bp, Artificial Sequence
  Single strand DNA oligonucleotide
tttggtaccggtcgtatcataaggataaggtttc

SEQ ID NO: 7313 - DNA, 36 bp, Artificial Sequence
  Single strand DNA oligonucleotide
tttggtaccttattaagcatactctggattgtgtgc

SEQ ID NO: 7314 - DNA, 30 bp, Artificial Sequence
  Single strand DNA oligonucleotide
aaaggtaccggcatcaacacaagattcaac

SEQ ID NO: 7315 - DNA, 31 bp, Artificial Sequence
  Single strand DNA oligonucleotide
aaaggtaccacagtcattccagaacatcacg

SEQ ID NO: 7316 - DNA, 36 bp, Artificial Sequence
  Single strand DNA oligonucleotide
tttggtacctgctcattatcacctagacatctcatc

SEQ ID NO: 7317 - DNA, 31 bp, Artificial Sequence
  Single strand DNA oligonucleotide
aaagaattcgagtcaaacatgaaacgcagag

SEQ ID NO: 7318 - DNA, 31 bp, Artificial Sequence
  Single strand DNA oligonucleotide
aaaggtaccacatctttggttgagttccctg

SEQ ID NO: 7319 - DNA, 32 bp, Artificial Sequence
  Single strand DNA oligonucleotide
aaaggtaccttgctcgtattccaggttatttg

SEQ ID NO: 7320 - DNA, 30 bp, Artificial Sequence
  Single strand DNA oligonucleotide
aaaggtaccagacatggcttgcacacctac

SEQ ID NO: 7321 - DNA, 34 bp, Artificial Sequence
  Single strand DNA oligonucleotide
aaaggtacccgtacatctatcatggcattcaaag

SEQ ID NO: 7322 - DNA, 31 bp, Artificial Sequence
  Single strand DNA oligonucleotide
aaaggtaccctttatttcccggactggagac

SEQ ID NO: 7323 - DNA, 31 bp, Artificial Sequence
  Single strand DNA oligonucleotide
aaaggtacccaaagcactgaaccatatgacg

SEQ ID NO: 7324 - DNA, 31 bp, Artificial Sequence
  Single strand DNA oligonucleotide
aaaggtaccctcgaaacagaggccactagac

SEQ ID NO: 7325 - DNA, 35 bp, Artificial Sequence
  Single strand DNA oligonucleotide
aaaggtaccctaacgagacctctctcttgtgtgtg

SEQ ID NO: 7326 - DNA, 31 bp, Artificial Sequence
  Single strand DNA oligonucleotide
aaagaattcttgaaattgctgaacctcacag

SEQ ID NO: 7327 - DNA, 31 bp, Artificial Sequence
  Single strand DNA oligonucleotide
aaaggtacccgagccagagaaacaacttacc

SEQ ID NO: 7328 - DNA, 34 bp, Artificial Sequence
  Single strand DNA oligonucleotide
aaagaattcttcatctcccgtctatatgtactcc

SEQ ID NO: 7329 - DNA, 31 bp, Artificial Sequence
  Single strand DNA oligonucleotide
aaagaattctcatcagacgctcgttattcac

SEQ ID NO: 7330 - DNA, 34 bp, Artificial Sequence
  Single strand DNA oligonucleotide
aaaggatccatcgaagcgagttttattttacagg

SEQ ID NO: 7331 - DNA, 31 bp, Artificial Sequence
  Single strand DNA oligonucleotide
aaagaattcagtttcacagcgcaaataacag

SEQ ID NO: 7332 - DNA, 31 bp, Artificial Sequence
  Single strand DNA oligonucleotide
aaaggatcctccatggaaccaagatcatacc

SEQ ID NO: 7333 - DNA, 36 bp, Artificial Sequence
  Single strand DNA oligonucleotide
aacggtacctcacagcactaacagaccagatgatca

SEQ ID NO: 7334 - DNA, 32 bp, Artificial Sequence
  Single strand DNA oligonucleotide
aaaggtaccccttgaataattacacagcgacg

SEQ ID NO: 7335 - DNA, 31 bp, Artificial Sequence
  Single strand DNA oligonucleotide
aaaggtaccgtcatttcctccgtttctatgc

SEQ ID NO: 7336 - DNA, 31 bp, Artificial Sequence
  Single strand DNA oligonucleotide
aaaaggcctcatgcagatttgaccagagatg

SEQ ID NO: 7337 - DNA, 31 bp, Artificial Sequence
  Single strand DNA oligonucleotide
aaagaattccattgtgaaacggagggagtag

SEQ ID NO: 7338 - DNA, 31 bp, Artificial Sequence
  Single strand DNA oligonucleotide
aaaggtacccaagtcaaacaacgaacagctc

SEQ ID NO: 7339 - DNA, 31 bp, Artificial Sequence
  Single strand DNA oligonucleotide
aaaggtaccctccaaccatgtgttactgtgg

SEQ ID NO: 7340 - DNA, 32 bp, Artificial Sequence
  Single strand DNA oligonucleotide
aaaggtaccaaaggtccggttgtaaatactcg

SEQ ID NO: 7341 - DNA, 33 bp, Artificial Sequence
  Single strand DNA oligonucleotide
aaaaggcctggaactgagcagagctgattaaag

SEQ ID NO: 7342 - DNA, 31 bp, Artificial Sequence
  Single strand DNA oligonucleotide
aaaggtacccttatcagcacgcctcctctac

SEQ ID NO: 7343 - DNA, 32 bp, Artificial Sequence
  Single strand DNA oligonucleotide
aaaggtacccatcacgcctttagtacatttgc

SEQ ID NO: 7344 - DNA, 31 bp, Artificial Sequence
  Single strand DNA oligonucleotide
aaaaggcctttccgatcttactcgtacccac

SEQ ID NO: 7345 - DNA, 31 bp, Artificial Sequence
  Single strand DNA oligonucleotide
aaaaggccttgatagtacgttacacgggagc

SEQ ID NO: 7346 - DNA, 31 bp, Artificial Sequence
  Single strand DNA oligonucleotide
aaaggtacctcaatctgctcgatctcaattc

SEQ ID NO: 7347 - DNA, 37 bp, Artificial Sequence
  Single strand DNA oligonucleotide
aacgaattctcaaacgataatactggtaagcaggacg

SEQ ID NO: 7348 - DNA, 31 bp, Artificial Sequence
  Single strand DNA oligonucleotide
aaaggtaccagatcgtacttcatcaggcagg

SEQ ID NO: 7349 - DNA, 33 bp, Artificial Sequence
  Single strand DNA oligonucleotide
tttaggcctcaagaacattggtgttacaacagc

SEQ ID NO: 7350 - DNA, 31 bp, Artificial Sequence
  Single strand DNA oligonucleotide
aaaggtacctaactgcaccatttgtcaggag

SEQ ID NO: 7351 - DNA, 34 bp, Artificial Sequence
  Single strand DNA oligonucleotide
aaaggtaccctaaactagaagcacgaacgcaaac

SEQ ID NO: 7352 - DNA, 37 bp, Artificial Sequence
  Single strand DNA oligonucleotide
aacgaattctcatcacttcagtacatctttgagcaga

SEQ ID NO: 7353 - DNA, 31 bp, Artificial Sequence
  Single strand DNA oligonucleotide
aaaggtaccaatcacaaaccaagacatcacg

SEQ ID NO: 7354 - DNA, 31 bp, Artificial Sequence
  Single strand DNA oligonucleotide
aaaggtaccagctcagaccaacaatgtttcc

SEQ ID NO: 7355 - DNA, 32 bp, Artificial Sequence
  Single strand DNA oligonucleotide
tttggtacccctgctcgaataatgtgacatcc

SEQ ID NO: 7356 - DNA, 31 bp, Artificial Sequence
  Single strand DNA oligonucleotide
aaagaattcacctggtagctcatattgcctg

SEQ ID NO: 7357 - DNA, 32 bp, Artificial Sequence
  Single strand DNA oligonucleotide
aaaggtaccagtgaggaacgtaaacaacatgc

SEQ ID NO: 7358 - DNA, 31 bp, Artificial Sequence
  Single strand DNA oligonucleotide
aaaggtaccacacagcaaatccctactggtc

SEQ ID NO: 7359 - DNA, 31 bp, Artificial Sequence
  Single strand DNA oligonucleotide
aaaggatcccagagttacaagcacttcgctg

SEQ ID NO: 7360 - DNA, 34 bp, Artificial Sequence
  Single strand DNA oligonucleotide
aaaggtaccctaatgttggaaatgagagcaaatg

SEQ ID NO: 7361 - DNA, 32 bp, Artificial Sequence
  Single strand DNA oligonucleotide
aaaggtaccctgtcagacttgacttccactcc

SEQ ID NO: 7362 - DNA, 32 bp, Artificial Sequence
  Single strand DNA oligonucleotide
aataggcctcaccagaaagcttacaacaatgc

SEQ ID NO: 7363 - DNA, 31 bp, Artificial Sequence
  Single strand DNA oligonucleotide
aaaggtacctgtcaacgaacagaacaccttc

SEQ ID NO: 7364 - DNA, 32 bp, Artificial Sequence
  Single strand DNA oligonucleotide
aaaggtacctggaaacatcctagacaaacgag

SEQ ID NO: 7365 - DNA, 38 bp, Artificial Sequence
  Single strand DNA oligonucleotide
aaaggtacctcatcaaaatttgtaaaccatttgctcag

SEQ ID NO: 7366 - DNA, 34 bp, Artificial Sequence
  Single strand DNA oligonucleotide
aaaaggcctacatgaatttcacagcaatacaaac

SEQ ID NO: 7367 - DNA, 31 bp, Artificial Sequence
  Single strand DNA oligonucleotide
aaagaattctccatcacctctagggtctagc

SEQ ID NO: 7368 - DNA, 31 bp, Artificial Sequence
  Single strand DNA oligonucleotide
aaaggtacctccatcatcatagtgggacaac

SEQ ID NO: 7369 - DNA, 36 bp, Artificial Sequence
  Single strand DNA oligonucleotide
tttaggccttcatgttgtggatcaaagacttagtcc

SEQ ID NO: 7370 - DNA, 35 bp, Artificial Sequence
  Single strand DNA oligonucleotide
tttgaattcttatccttaaaaaggccttttgagac

SEQ ID NO: 7371 - DNA, 35 bp, Artificial Sequence
  Single strand DNA oligonucleotide
tttggtaccttacatgtatatagcgactcaagcgt

SEQ ID NO: 7372 - DNA, 36 bp, Artificial Sequence
  Single strand DNA oligonucleotide
aaaggtacctcttctatttacataagaaactgggga

SEQ ID NO: 7373 - DNA, 31 bp, Artificial Sequence
  Single strand DNA oligonucleotide
aaaggtacccaggaaccatggctatgaaatc

SEQ ID NO: 7374 - DNA, 31 bp, Artificial Sequence
  Single strand DNA oligonucleotide
aaagaattcaccttgttgggagcaataaatg

SEQ ID NO: 7375 - DNA, 31 bp, Artificial Sequence
  Single strand DNA oligonucleotide
aaaggtacccttgctctaacccatgtccaac

SEQ ID NO: 7376 - DNA, 37 bp, Artificial Sequence
  Single strand DNA oligonucleotide
aaaggtaccctatcgatggaataaatctaagacaagc

SEQ ID NO: 7377 - DNA, 31 bp, Artificial Sequence
  Single strand DNA oligonucleotide
aaaggtacctagcaaccctttagtgccagac

SEQ ID NO: 7378 - DNA, 33 bp, Artificial Sequence
  Single strand DNA oligonucleotide
aaaggtaccgagacatagacaatcatcggacag

SEQ ID NO: 7379 - DNA, 33 bp, Artificial Sequence
  Single strand DNA oligonucleotide
aaagaattctgataagatttgaccgtaccatcc

SEQ ID NO: 7380 - DNA, 36 bp, Artificial Sequence
  Single strand DNA oligonucleotide
aaaggtaccttcaaacaccaccaattaacaacatag

SEQ ID NO: 7381 - DNA, 31 bp, Artificial Sequence
  Single strand DNA oligonucleotide
aaaggtaccacaataacaaagcctttcctcg

SEQ ID NO: 7382 - DNA, 32 bp, Artificial Sequence
  Single strand DNA oligonucleotide
aaagaattcagttactcacaacatctcgccac

SEQ ID NO: 7383 - DNA, 31 bp, Artificial Sequence
  Single strand DNA oligonucleotide
aaagaattccatcgttaaattggtttgctcg

SEQ ID NO: 7384 - DNA, 31 bp, Artificial Sequence
  Single strand DNA oligonucleotide
aaaggtaccgcaacacctgtattcgtctttg

SEQ ID NO: 7385 - DNA, 31 bp, Artificial Sequence
  Single strand DNA oligonucleotide
aaaggtaccacttcctttcgtggtatgatgg

SEQ ID NO: 7386 - DNA, 31 bp, Artificial Sequence
  Single strand DNA oligonucleotide
aaagaattcttacgaaacgcatggtttatcc

SEQ ID NO: 7387 - DNA, 31 bp, Artificial Sequence
  Single strand DNA oligonucleotide
aaaggtacctatacaacccactgactggctg

SEQ ID NO: 7388 - DNA, 31 bp, Artificial Sequence
  Single strand DNA oligonucleotide
aaaggtacccctgtggacaagtcaacttcag

SEQ ID NO: 7389 - DNA, 31 bp, Artificial Sequence
  Single strand DNA oligonucleotide
aaagaattctaatttacaaaccacggccttc

SEQ ID NO: 7390 - DNA, 30 bp, Artificial Sequence
  Single strand DNA oligonucleotide
aaaggatccaattcaaacgctagcccaaac

SEQ ID NO: 7391 - DNA, 30 bp, Artificial Sequence
  Single strand DNA oligonucleotide
aaagaattcctttcatttccggcagcatac

SEQ ID NO: 7392 - DNA, 33 bp, Artificial Sequence
  Single strand DNA oligonucleotide
aaaggtaccgcacgtcgaagctcttatttattc

SEQ ID NO: 7393 - DNA, 31 bp, Artificial Sequence
  Single strand DNA oligonucleotide
aaaggtaccgaagctaagcaagagcatcgac

SEQ ID NO: 7394 - DNA, 34 bp, Artificial Sequence
  Single strand DNA oligonucleotide
aaagaattcctaagttagagatggccaggaaacc

SEQ ID NO: 7395 - DNA, 31 bp, Artificial Sequence
  Single strand DNA oligonucleotide
aaaggtacctgccaattacaacgagtgctac

SEQ ID NO: 7396 - DNA, 31 bp, Artificial Sequence
  Single strand DNA oligonucleotide
aaaggtacccgtacgaacacaagctaacacg

SEQ ID NO: 7397 - DNA, 31 bp, Artificial Sequence
  Single strand DNA oligonucleotide
aaaggtaccaaacggatggattcacagaaac

SEQ ID NO: 7398 - DNA, 31 bp, Artificial Sequence
  Single strand DNA oligonucleotide
aaaggtacccttaagcagaaagccgtctcac

SEQ ID NO: 7399 - DNA, 31 bp, Artificial Sequence
  Single strand DNA oligonucleotide
aaaggtaccccaatagctagcagccagtacg

SEQ ID NO: 7400 - DNA, 31 bp, Artificial Sequence
  Single strand DNA oligonucleotide
aaaggatccgctaaactaacgcgctacgatg

SEQ ID NO: 7401 - DNA, 31 bp, Artificial Sequence
  Single strand DNA oligonucleotide
aaaggtacctcccacaacatgataccacttc

SEQ ID NO: 7402 - DNA, 32 bp, Artificial Sequence
  Single strand DNA oligonucleotide
aaaggtaccttcacagtacaaacaacacgcag

SEQ ID NO: 7403 - DNA, 33 bp, Artificial Sequence
  Single strand DNA oligonucleotide
aaaggtacccagaggcataaataacacgcatac

SEQ ID NO: 7404 - DNA, 31 bp, Artificial Sequence
  Single strand DNA oligonucleotide
aaaggtaccaaatgctatacacattgccacg

SEQ ID NO: 7405 - DNA, 39 bp, Artificial Sequence
  Single strand DNA oligonucleotide
tttggtaccctagtctgactgcttcactgtgaagtaaag

SEQ ID NO: 7406 - DNA, 29 bp, Artificial Sequence
  Single strand DNA oligonucleotide
aaaaggcctcagcaaggaatggattcagc

SEQ ID NO: 7407 - DNA, 36 bp, Artificial Sequence
  Single strand DNA oligonucleotide
aaaggatccggagaacagatagcagaagtatgaaag

SEQ ID NO: 7408 - DNA, 31 bp, Artificial Sequence
  Single strand DNA oligonucleotide
aaaggtaccgaggtaacatccgaccgatatg

SEQ ID NO: 7409 - DNA, 31 bp, Artificial Sequence
  Single strand DNA oligonucleotide
aaagaattccatgcaaaccaggcatagatag

SEQ ID NO: 7410 - DNA, 31 bp, Artificial Sequence
  Single strand DNA oligonucleotide
aaaggtaccccagactacgacccacctattg

SEQ ID NO: 7411 - DNA, 30 bp, Artificial Sequence
  Single strand DNA oligonucleotide
aaaggtaccgatccgcgtgtacaacttctg

SEQ ID NO: 7412 - DNA, 31 bp, Artificial Sequence
  Single strand DNA oligonucleotide
aaaggtaccacaactcaacaactgagcatcg

SEQ ID NO: 7413 - DNA, 31 bp, Artificial Sequence
  Single strand DNA oligonucleotide
aaaggtaccccaacagaaaccaaaccatagg

SEQ ID NO: 7414 - DNA, 32 bp, Artificial Sequence
  Single strand DNA oligonucleotide
aaaggtaccccataccatgatattcacacacg

SEQ ID NO: 7415 - DNA, 31 bp, Artificial Sequence
  Single strand DNA oligonucleotide
aaagaattcagcaaatcaatcagccaagaac

SEQ ID NO: 7416 - DNA, 31 bp, Artificial Sequence
  Single strand DNA oligonucleotide
aaaggtacccgaggaactcatcgataactgg

SEQ ID NO: 7417 - DNA, 31 bp, Artificial Sequence
  Single strand DNA oligonucleotide
aaaggtacctcctttattcctcgcagatacg

SEQ ID NO: 7418 - DNA, 30 bp, Artificial Sequence
  Single strand DNA oligonucleotide
aaaaggcctacaatttggttgaccttgcac

SEQ ID NO: 7419 - DNA, 31 bp, Artificial Sequence
  Single strand DNA oligonucleotide
aaaggtaccgcatgctatgctatgctaccac

SEQ ID NO: 7420 - DNA, 31 bp, Artificial Sequence
  Single strand DNA oligonucleotide
aaaggtaccaccattttaccaagccatttcc

SEQ ID NO: 7421 - DNA, 31 bp, Artificial Sequence
  Single strand DNA oligonucleotide
aaagtcgacgcacgattaccaggtgtttagg

SEQ ID NO: 7422 - DNA, 31 bp, Artificial Sequence
  Single strand DNA oligonucleotide
aaaggtaccggatacacacgggtaatggaag

SEQ ID NO: 7423 - DNA, 31 bp, Artificial Sequence
  Single strand DNA oligonucleotide
aaaggtaccaacaagcccggttcttattctc

SEQ ID NO: 7424 - DNA, 31 bp, Artificial Sequence
  Single strand DNA oligonucleotide
aaaggtacctggatacactgatgcacgaaag

SEQ ID NO: 7425 - DNA, 31 bp, Artificial Sequence
  Single strand DNA oligonucleotide
tttaggccttcatcagtacgcaagcgagtcc

SEQ ID NO: 7426 - DNA, 34 bp, Artificial Sequence
  Single strand DNA oligonucleotide
aaaggtaccctagcaagagaagctaggtggagtg

SEQ ID NO: 7427 - DNA, 31 bp, Artificial Sequence
  Single strand DNA oligonucleotide
aaaggtaccatcacaagtgcaattcaccatc

SEQ ID NO: 7428 - DNA, 32 bp, Artificial Sequence
  Single strand DNA oligonucleotide
aaagaattcaattgctagttgcacaaatggac

SEQ ID NO: 7429 - DNA, 31 bp, Artificial Sequence
  Single strand DNA oligonucleotide
aaaggtaccagaatgctggcgaattactgtc

SEQ ID NO: 7430 - DNA, 31 bp, Artificial Sequence
  Single strand DNA oligonucleotide
aaaggtacctctcaggctcgttggtttattc

SEQ ID NO: 7431 - DNA, 31 bp, Artificial Sequence
  Single strand DNA oligonucleotide
aaaggtaccactttactcgacgcagaactcc

SEQ ID NO: 7432 - DNA, 31 bp, Artificial Sequence
  Single strand DNA oligonucleotide
aaaggtacctctcggaaagaacacaaacgac

SEQ ID NO: 7433 - DNA, 31 bp, Artificial Sequence
  Single strand DNA oligonucleotide
aaaggtaccacaacatccagagttccagacc

SEQ ID NO: 7434 - DNA, 31 bp, Artificial Sequence
  Single strand DNA oligonucleotide
aaaggtaccatctgtttcccgtcagtcaatc

SEQ ID NO: 7435 - DNA, 31 bp, Artificial Sequence
  Single strand DNA oligonucleotide
aaaggtaccgacgattccatttcattccaag

SEQ ID NO: 7436 - DNA, 32 bp, Artificial Sequence
  Single strand DNA oligonucleotide
aaaggtaccgggctgcttatatatgttcctgc

SEQ ID NO: 7437 - DNA, 32 bp, Artificial Sequence
  Single strand DNA oligonucleotide
aaaggtaccgtggtaatacactgcagcacaag

SEQ ID NO: 7438 - DNA, 31 bp, Artificial Sequence
  Single strand DNA oligonucleotide
aaaggtaccaactacgaaatcgagcaagctg

SEQ ID NO: 7439 - DNA, 31 bp, Artificial Sequence
  Single strand DNA oligonucleotide
aaaggtacccttatcagccaaacgaacaagg

SEQ ID NO: 7440 - DNA, 36 bp, Artificial Sequence
  Single strand DNA oligonucleotide
tttaggcctcagtttgtaatctgtacacgtcatagc

SEQ ID NO: 7441 - DNA, 31 bp, Artificial Sequence
  Single strand DNA oligonucleotide
aaagaattcgctctgtccttagattcggaag

SEQ ID NO: 7442 - DNA, 31 bp, Artificial Sequence
  Single strand DNA oligonucleotide
aaaggtacccttcggttcttcatctacgagc

SEQ ID NO: 7443 - DNA, 30 bp, Artificial Sequence
  Single strand DNA oligonucleotide
aaaggtaccctccttcaaacgaaccagagg

SEQ ID NO: 7444 - DNA, 32 bp, Artificial Sequence
  Single strand DNA oligonucleotide
ttaaggcctagaactaagaacgggagggaatc

SEQ ID NO: 7445 - DNA, 31 bp, Artificial Sequence
  Single strand DNA oligonucleotide
aaagaattcatagaaggcagaatgaacgctg

SEQ ID NO: 7446 - DNA, 31 bp, Artificial Sequence
  Single strand DNA oligonucleotide
aaagaattcctacagtcaggccataggcaac

SEQ ID NO: 7447 - DNA, 31 bp, Artificial Sequence
  Single strand DNA oligonucleotide
aaagatatctccgtacgtatcaaacaacgac

SEQ ID NO: 7448 - DNA, 31 bp, Artificial Sequence
  Single strand DNA oligonucleotide
aaaggtaccgtcaactcagaagtggcaacac

SEQ ID NO: 7449 - DNA, 31 bp, Artificial Sequence
  Single strand DNA oligonucleotide
aaagaattcccgttcaattagaaccctgatg

SEQ ID NO: 7450 - DNA, 31 bp, Artificial Sequence
  Single strand DNA oligonucleotide
aaaaggcctccgagtttaatttccgacactc

SEQ ID NO: 7451 - DNA, 31 bp, Artificial Sequence
  Single strand DNA oligonucleotide
aaagaattccacaaggagagcggaagtagtc

SEQ ID NO: 7452 - DNA, 32 bp, Artificial Sequence
  Single strand DNA oligonucleotide
aaaggtacccaacaaaacgcagtaggaacatc

SEQ ID NO: 7453 - DNA, 24 bp, Artificial Sequence
  Single strand DNA oligonucleotide
actcttggatagccactgtttcag

SEQ ID NO: 7454 - DNA, 22 bp, Artificial Sequence
  Single strand DNA oligonucleotide
gaaagtaaggcctcatcaggtg

SEQ ID NO: 7455 - DNA, 31 bp, Artificial Sequence
  Single strand DNA oligonucleotide
aaaggtaccccagtacaccacgctgtatgac

SEQ ID NO: 7456 - DNA, 35 bp, Artificial Sequence
  Single strand DNA oligonucleotide
aaaggtaccctacaatggcaacaagaatttaatcg

SEQ ID NO: 7457 - DNA, 31 bp, Artificial Sequence
  Single strand DNA oligonucleotide
tttggtaccctaagcctagagctccgcagtg

SEQ ID NO: 7458 - DNA, 34 bp, Artificial Sequence
  Single strand DNA oligonucleotide
ttcggtaccaacttaagcacgttactggaaattg

SEQ ID NO: 7459 - DNA, 31 bp, Artificial Sequence
  Single strand DNA oligonucleotide
aaaggtaccaacaaacagcacgtcgattatg

SEQ ID NO: 7460 - DNA, 30 bp, Artificial Sequence
  Single strand DNA oligonucleotide
tttggtacctcatcatttgcaggtgcatgg

SEQ ID NO: 7461 - DNA, 31 bp, Artificial Sequence
  Single strand DNA oligonucleotide
aaaggtacctcaaaaccagcaaccacaacta

SEQ ID NO: 7462 - DNA, 31 bp, Artificial Sequence
  Single strand DNA oligonucleotide
tttggtacccatcatatcttggtgttccgtc

SEQ ID NO: 7463 - DNA, 31 bp, Artificial Sequence
  Single strand DNA oligonucleotide
tttaggcctgacaatgagccagtcgttaacg

SEQ ID NO: 7464 - DNA, 31 bp, Artificial Sequence
  Single strand DNA oligonucleotide
aaagaattcaccatctcaggcttatggtttg

SEQ ID NO: 7465 - DNA, 31 bp, Artificial Sequence
  Single strand DNA oligonucleotide
aaaggtaccatccgtcgagagagatacatgc

SEQ ID NO: 7466 - DNA, 31 bp, Artificial Sequence
  Single strand DNA oligonucleotide
aaaggtaccttagccaaaccttaaatggtgc

SEQ ID NO: 7467 - DNA, 31 bp, Artificial Sequence
  Single strand DNA oligonucleotide
aaaggtacccagctccagcataccgaaatag

SEQ ID NO: 7468 - DNA, 41 bp, Artificial Sequence
  Single strand DNA oligonucleotide
tttgaattcttagaattagtaaggtgtagcagtttgagtca

SEQ ID NO: 7469 - DNA, 26 bp, Artificial Sequence
  Single strand DNA oligonucleotide
tttgaattcccgccatggctttctcg

SEQ ID NO: 7470 - DNA, 31 bp, Artificial Sequence
  Single strand DNA oligonucleotide
aaaggatccgatgtgcatttcttcctgtcac

SEQ ID NO: 7471 - DNA, 31 bp, Artificial Sequence
  Single strand DNA oligonucleotide
aaagtcgaccacgaggagaaagtgagttgtg

SEQ ID NO: 7472 - DNA, 32 bp, Artificial Sequence
  Single strand DNA oligonucleotide
aaactcgaggcaagaggaatatgaagccatac

SEQ ID NO: 7473 - DNA, 35 bp, Artificial Sequence
  Single strand DNA oligonucleotide
aaaggatccgtcactatgaaaaacacatcaaaaag

SEQ ID NO: 7474 - DNA, 31 bp, Artificial Sequence
  Single strand DNA oligonucleotide
aaaggatccgttctcaccaaatgtcccaaac

SEQ ID NO: 7475 - DNA, 31 bp, Artificial Sequence
  Single strand DNA oligonucleotide
aaagtcgacgaatctgcagcaacaagacaag

SEQ ID NO: 7476 - DNA, 28 bp, Artificial Sequence
  Single strand DNA oligonucleotide
aaagtcgacgctttggctcctctccttg

SEQ ID NO: 7477 - DNA, 27 bp, Artificial Sequence
  Single strand DNA oligonucleotide
aaactcgagccacacaaactccgctcc

SEQ ID NO: 7478 - DNA, 32 bp, Artificial Sequence
  Single strand DNA oligonucleotide
aaaggatccggctatcagcaagtaggagaagg

SEQ ID NO: 7479 - DNA, 31 bp, Artificial Sequence
  Single strand DNA oligonucleotide
aaaggatcccattggttttgtttttcgatcg

SEQ ID NO: 7480 - DNA, 33 bp, Artificial Sequence
  Single strand DNA oligonucleotide
aaaggatccaactaatggctgagttaaacggag

SEQ ID NO: 7481 - DNA, 29 bp, Artificial Sequence
  Single strand DNA oligonucleotide
aaagatatcccgatccaaaatcatcaagc

SEQ ID NO: 7482 - DNA, 30 bp, Artificial Sequence
  Single strand DNA oligonucleotide
aaaggatccccgtatttccctctgatcctg

SEQ ID NO: 7483 - DNA, 29 bp, Artificial Sequence
  Single strand DNA oligonucleotide
aaaggatccagaggcgcagacacactttc

SEQ ID NO: 7484 - DNA, 31 bp, Artificial Sequence
  Single strand DNA oligonucleotide
aaaggatcctcttcttcctacccatttccag

SEQ ID NO: 7485 - DNA, 27 bp, Artificial Sequence
  Single strand DNA oligonucleotide
aaaggatcccactcgagcggagcagag

SEQ ID NO: 7486 - DNA, 35 bp, Artificial Sequence
  Single strand DNA oligonucleotide
aaaggatccccatctaaactaggtggaacagtacg

SEQ ID NO: 7487 - DNA, 30 bp, Artificial Sequence
  Single strand DNA oligonucleotide
aaaggatccaactgttccacagtcgtcgtc

SEQ ID NO: 7488 - DNA, 29 bp, Artificial Sequence
  Single strand DNA oligonucleotide
aaagtcgacgaaccatgagctctcggatg

SEQ ID NO: 7489 - DNA, 26 bp, Artificial Sequence
  Single strand DNA oligonucleotide
aaaggatccgtggagacgatggcccc

SEQ ID NO: 7490 - DNA, 31 bp, Artificial Sequence
  Single strand DNA oligonucleotide
aaagtcgacctcgtctctgattctccaaagc

SEQ ID NO: 7491 - DNA, 28 bp, Artificial Sequence
  Single strand DNA oligonucleotide
aaaggatccaagaacgtggctgcacatc

SEQ ID NO: 7492 - DNA, 31 bp, Artificial Sequence
  Single strand DNA oligonucleotide
aaaggatccttactagacctgacccgacctg

SEQ ID NO: 7493 - DNA, 27 bp, Artificial Sequence
  Single strand DNA oligonucleotide
aaaggatccgtcaaagccgcaagaagc

SEQ ID NO: 7494 - DNA, 31 bp, Artificial Sequence
  Single strand DNA oligonucleotide
aaaggatccaaacacacaccagcagaagaag

SEQ ID NO: 7495 - DNA, 30 bp, Artificial Sequence
  Single strand DNA oligonucleotide
aaaggatccagtcccagtcctctgaaccag

SEQ ID NO: 7496 - DNA, 27 bp, Artificial Sequence
  Single strand DNA oligonucleotide
aaaggatccgaaaccgccaaatcctcc

SEQ ID NO: 7497 - DNA, 29 bp, Artificial Sequence
  Single strand DNA oligonucleotide
aaagaattcgagtcgagggttctggagag

SEQ ID NO: 7498 - DNA, 29 bp, Artificial Sequence
  Single strand DNA oligonucleotide
aaagtcgacctgcccaactactcctccac

SEQ ID NO: 7499 - DNA, 27 bp, Artificial Sequence
  Single strand DNA oligonucleotide
aaagtcgacgctccaactcctgccacc

SEQ ID NO: 7500 - DNA, 27 bp, Artificial Sequence
  Single strand DNA oligonucleotide
aaagaattcggccaagaagaacctccg

SEQ ID NO: 7501 - DNA, 31 bp, Artificial Sequence
  Single strand DNA oligonucleotide
aaaggatcccatatcctacccgtttaccagc

SEQ ID NO: 7502 - DNA, 29 bp, Artificial Sequence
  Single strand DNA oligonucleotide
aaaggatccgcacagagcacagagagctg

SEQ ID NO: 7503 - DNA, 29 bp, Artificial Sequence
  Single strand DNA oligonucleotide
aaaggatccccaacagccagcgctataag

SEQ ID NO: 7504 - DNA, 31 bp, Artificial Sequence
  Single strand DNA oligonucleotide
aaactcgaggtccagatgagttcgaagaagg

SEQ ID NO: 7505 - DNA, 31 bp, Artificial Sequence
  Single strand DNA oligonucleotide
aaaggatccgtctctgccttcgtctctcaac

SEQ ID NO: 7506 - DNA, 26 bp, Artificial Sequence
  Single strand DNA oligonucleotide
aaaggatccccgggatgctgcacgag

SEQ ID NO: 7507 - DNA, 30 bp, Artificial Sequence
  Single strand DNA oligonucleotide
aaaggatcctagaaccctctccaggtctcg

SEQ ID NO: 7508 - DNA, 31 bp, Artificial Sequence
  Single strand DNA oligonucleotide
aaaggatcctactatagtgtgcgcaagggac

SEQ ID NO: 7509 - DNA, 29 bp, Artificial Sequence
  Single strand DNA oligonucleotide
aaaggatcctgttgactcctcccaccttc

SEQ ID NO: 7510 - DNA, 32 bp, Artificial Sequence
  Single strand DNA oligonucleotide
aaaggatcccaatctttcccttcttcttctcg

SEQ ID NO: 7511 - DNA, 33 bp, Artificial Sequence
  Single strand DNA oligonucleotide
aaagtcgacttctttaggagggtggtcaatatg

SEQ ID NO: 7512 - DNA, 31 bp, Artificial Sequence
  Single strand DNA oligonucleotide
aaagtcgacaatcaaggagagtgctttgtgg

SEQ ID NO: 7513 - DNA, 31 bp, Artificial Sequence
  Single strand DNA oligonucleotide
aaaggatccctaagttcctttgctgtgggag

SEQ ID NO: 7514 - DNA, 32 bp, Artificial Sequence
  Single strand DNA oligonucleotide
aaaggatccaacgaaggttaaaggaaccacac

SEQ ID NO: 7515 - DNA, 27 bp, Artificial Sequence
  Single strand DNA oligonucleotide
aaaggatccggaccatggcagtgacag

SEQ ID NO: 7516 - DNA, 30 bp, Artificial Sequence
  Single strand DNA oligonucleotide
aaaggatccaaaagatgggtgaggagcagc

SEQ ID NO: 7517 - DNA, 35 bp, Artificial Sequence
  Single strand DNA oligonucleotide
aaaggatcccttctgttgttgtcttcaatggtact

SEQ ID NO: 7518 - DNA, 31 bp, Artificial Sequence
  Single strand DNA oligonucleotide
aaaggatccatgcattccatctttcaaggac

SEQ ID NO: 7519 - DNA, 32 bp, Artificial Sequence
  Single strand DNA oligonucleotide
aaagtcgacccttcacttcagctcaaagaacc

SEQ ID NO: 7520 - DNA, 29 bp, Artificial Sequence
  Single strand DNA oligonucleotide
aaaggatcccccaatcaacgctgcaatac

SEQ ID NO: 7521 - DNA, 36 bp, Artificial Sequence
  Single strand DNA oligonucleotide
aaaggatccagtacatggggatcataaaactcagac

SEQ ID NO: 7522 - DNA, 31 bp, Artificial Sequence
  Single strand DNA oligonucleotide
aaaggatcctctcttcttgtctccaacatcg

SEQ ID NO: 7523 - DNA, 31 bp, Artificial Sequence
  Single strand DNA oligonucleotide
aaagtcgaccagcaaccatctaccatccatc

SEQ ID NO: 7524 - DNA, 33 bp, Artificial Sequence
  Single strand DNA oligonucleotide
aaagatatctgtggttctagttcttgttatggc

SEQ ID NO: 7525 - DNA, 31 bp, Artificial Sequence
  Single strand DNA oligonucleotide
aaaggatccgtcccttcattcagaaacttcc

SEQ ID NO: 7526 - DNA, 29 bp, Artificial Sequence
  Single strand DNA oligonucleotide
aaagtcgacatcgagcaacgcctatcatc

SEQ ID NO: 7527 - DNA, 32 bp, Artificial Sequence
  Single strand DNA oligonucleotide
aaagatatcgtactgctactgctagctccagg

SEQ ID NO: 7528 - DNA, 30 bp, Artificial Sequence
  Single strand DNA oligonucleotide
aaaggatccagatggctctccattctccac

SEQ ID NO: 7529 - DNA, 31 bp, Artificial Sequence
  Single strand DNA oligonucleotide
aaaggatccaggcaccaacaaagttaagtgg

SEQ ID NO: 7530 - DNA, 30 bp, Artificial Sequence
  Single strand DNA oligonucleotide
aaagtcgacgagagccctcgagataccatc

SEQ ID NO: 7531 - DNA, 31 bp, Artificial Sequence
  Single strand DNA oligonucleotide
aaaggatccttcttctataccacgcgtccac

SEQ ID NO: 7532 - DNA, 28 bp, Artificial Sequence
  Single strand DNA oligonucleotide
aaaggatccagccagacaacacgtggac

SEQ ID NO: 7533 - DNA, 31 bp, Artificial Sequence
  Single strand DNA oligonucleotide
aaaggatccatcgatgatttagcacggagag

SEQ ID NO: 7534 - DNA, 30 bp, Artificial Sequence
  Single strand DNA oligonucleotide
aaaggatcctacaactccacgagcttccac

SEQ ID NO: 7535 - DNA, 28 bp, Artificial Sequence
  Single strand DNA oligonucleotide
aaagtcgacgtttcaagcacaacgctgc

SEQ ID NO: 7536 - DNA, 27 bp, Artificial Sequence
  Single strand DNA oligonucleotide
aaaggatccccctgcattgcacatcac

SEQ ID NO: 7537 - DNA, 31 bp, Artificial Sequence
  Single strand DNA oligonucleotide
aaaggatccctccattgagcaagaggagaag

SEQ ID NO: 7538 - DNA, 30 bp, Artificial Sequence
  Single strand DNA oligonucleotide
aaaggatccggaggatgatgaggaagttgg

SEQ ID NO: 7539 - DNA, 30 bp, Artificial Sequence
  Single strand DNA oligonucleotide
aaactcgagctctgttgcaagggatctttc

SEQ ID NO: 7540 - DNA, 30 bp, Artificial Sequence
  Single strand DNA oligonucleotide
aaaggatccattgcaaatctgtcaccgaag

SEQ ID NO: 7541 - DNA, 31 bp, Artificial Sequence
  Single strand DNA oligonucleotide
aaaggatccgaatctcaatccacaggctcac

SEQ ID NO: 7542 - DNA, 31 bp, Artificial Sequence
  Single strand DNA oligonucleotide
aaaggatccattgtcctcctcttcccttgac

SEQ ID NO: 7543 - DNA, 31 bp, Artificial Sequence
  Single strand DNA oligonucleotide
aaaggatccattcacagcaacagcacatctc

SEQ ID NO: 7544 - DNA, 32 bp, Artificial Sequence
  Single strand DNA oligonucleotide
aaaggatcccatacatgcaccgacctaacttc

SEQ ID NO: 7545 - DNA, 31 bp, Artificial Sequence
  Single strand DNA oligonucleotide
aaagtcgacaactgccaataaacacagggtg

SEQ ID NO: 7546 - DNA, 27 bp, Artificial Sequence
  Single strand DNA oligonucleotide
aaagtcgacaaggaagggaaaccccac

SEQ ID NO: 7547 - DNA, 29 bp, Artificial Sequence
  Single strand DNA oligonucleotide
aaaggatcctgttcatccaaatccacagc

SEQ ID NO: 7548 - DNA, 29 bp, Artificial Sequence
  Single strand DNA oligonucleotide
aaaggatccaggcaatggcgagcactaag

SEQ ID NO: 7549 - DNA, 27 bp, Artificial Sequence
  Single strand DNA oligonucleotide
aaaggatcccgagacctccacgcttcc

SEQ ID NO: 7550 - DNA, 32 bp, Artificial Sequence
  Single strand DNA oligonucleotide
aaagtcgacgctccttcacctcctacatcttc

SEQ ID NO: 7551 - DNA, 32 bp, Artificial Sequence
  Single strand DNA oligonucleotide
aaaggatcctcctgcaaggctgtgttagttac

SEQ ID NO: 7552 - DNA, 31 bp, Artificial Sequence
  Single strand DNA oligonucleotide
aaaggatccaaacctaagtggctgtcccttc

SEQ ID NO: 7553 - DNA, 31 bp, Artificial Sequence
  Single strand DNA oligonucleotide
aaaggatccatcgtctttcttgctgttctgg

SEQ ID NO: 7554 - DNA, 31 bp, Artificial Sequence
  Single strand DNA oligonucleotide
aaagtcgacaacgcgtacttgatttcaggag

SEQ ID NO: 7555 - DNA, 29 bp, Artificial Sequence
  Single strand DNA oligonucleotide
aaaggatccgccgtcttagagcaagcctc

SEQ ID NO: 7556 - DNA, 28 bp, Artificial Sequence
  Single strand DNA oligonucleotide
aaaggatccgctaggcatggaccagctc

SEQ ID NO: 7557 - DNA, 30 bp, Artificial Sequence
  Single strand DNA oligonucleotide
aaagaattcccactctcatcggattcacac

SEQ ID NO: 7558 - DNA, 28 bp, Artificial Sequence
  Single strand DNA oligonucleotide
aaagtcgacgtcgtctctctcgcagtcg

SEQ ID NO: 7559 - DNA, 31 bp, Artificial Sequence
  Single strand DNA oligonucleotide
aaaggatccagcaaactcacaagtcccagac

SEQ ID NO: 7560 - DNA, 31 bp, Artificial Sequence
  Single strand DNA oligonucleotide
aaaggatccttcagacttcaagggagattcg

SEQ ID NO: 7561 - DNA, 26 bp, Artificial Sequence
  Single strand DNA oligonucleotide
aaaggatccctcccatgggttcgcag

SEQ ID NO: 7562 - DNA, 31 bp, Artificial Sequence
  Single strand DNA oligonucleotide
aaagtcgacgcctggaattgatggaattatc

SEQ ID NO: 7563 - DNA, 31 bp, Artificial Sequence
  Single strand DNA oligonucleotide
aaaggatccaatctagagagccttgggcttg

SEQ ID NO: 7564 - DNA, 31 bp, Artificial Sequence
  Single strand DNA oligonucleotide
aaaggatccattcccaagcatcttctcttcc

SEQ ID NO: 7565 - DNA, 30 bp, Artificial Sequence
  Single strand DNA oligonucleotide
aaaggatcctcctctccttgcagatgtttg

SEQ ID NO: 7566 - DNA, 29 bp, Artificial Sequence
  Single strand DNA oligonucleotide
aaaggatccgtccttcttaaaggcgcagg

SEQ ID NO: 7567 - DNA, 30 bp, Artificial Sequence
  Single strand DNA oligonucleotide
aaaggatcccatccaacacctaaacccctc

SEQ ID NO: 7568 - DNA, 29 bp, Artificial Sequence
  Single strand DNA oligonucleotide
aaagtcgaccacctctctccaattcgctg

SEQ ID NO: 7569 - DNA, 32 bp, Artificial Sequence
  Single strand DNA oligonucleotide
aaaggatccccattccattccaccagtctatc

SEQ ID NO: 7570 - DNA, 29 bp, Artificial Sequence
  Single strand DNA oligonucleotide
aaagtcgacgtttcttctccgtcgctttg

SEQ ID NO: 7571 - DNA, 32 bp, Artificial Sequence
  Single strand DNA oligonucleotide
aaagaattcggaagcagaggatgcagtaatag

SEQ ID NO: 7572 - DNA, 31 bp, Artificial Sequence
  Single strand DNA oligonucleotide
aaaggatcctccaaattcttcaatcgctttc

SEQ ID NO: 7573 - DNA, 31 bp, Artificial Sequence
  Single strand DNA oligonucleotide
aaaggatccagtacatggggagcttcaaaac

SEQ ID NO: 7574 - DNA, 28 bp, Artificial Sequence
  Single strand DNA oligonucleotide
aaagtcgacaacgataagcccgtgaacc

SEQ ID NO: 7575 - DNA, 31 bp, Artificial Sequence
  Single strand DNA oligonucleotide
aaaggatccactgtataattgtgctcgctcg

SEQ ID NO: 7576 - DNA, 29 bp, Artificial Sequence
  Single strand DNA oligonucleotide
aaaggatccgatcgcggaatccttatctg

SEQ ID NO: 7577 - DNA, 32 bp, Artificial Sequence
  Single strand DNA oligonucleotide
tttgtcgacgagcagatcaatggattctttcc

SEQ ID NO: 7578 - DNA, 27 bp, Artificial Sequence
  Single strand DNA oligonucleotide
tttaggcctgatttcgcgtgctcggtc

SEQ ID NO: 7579 - DNA, 31 bp, Artificial Sequence
  Single strand DNA oligonucleotide
aaaggtacctcaacatctaagctgtcgttgc

SEQ ID NO: 7580 - DNA, 31 bp, Artificial Sequence
  Single strand DNA oligonucleotide
aaaggatcctgtttcatccagctcgaatatg

SEQ ID NO: 7581 - DNA, 39 bp, Artificial Sequence
  Single strand DNA oligonucleotide
tttaggcctctactaatccttatgccagttactgtacca

SEQ ID NO: 7582 - DNA, 31 bp, Artificial Sequence
  Single strand DNA oligonucleotide
aaaggtaccgttaactcgtctcgttccttcc

SEQ ID NO: 7583 - DNA, 31 bp, Artificial Sequence
  Single strand DNA oligonucleotide
aaaggtaccttaacaacgttgatggatcgag

SEQ ID NO: 7584 - DNA, 35 bp, Artificial Sequence
  Single strand DNA oligonucleotide
aaaggtaccctaaatgatcctgcttgctaacttcg

SEQ ID NO: 7585 - DNA, 31 bp, Artificial Sequence
  Single strand DNA oligonucleotide
aaaggatccacagcgactgatattgcaagtg

SEQ ID NO: 7586 - DNA, 37 bp, Artificial Sequence
  Single strand DNA oligonucleotide
tttgaattccatgaacataggcatttctattaatgaa

SEQ ID NO: 7587 - DNA, 31 bp, Artificial Sequence
  Single strand DNA oligonucleotide
aaagaattccagtagcagcagcatcaatacc

SEQ ID NO: 7588 - DNA, 31 bp, Artificial Sequence
  Single strand DNA oligonucleotide
aaaggtaccagcacgcatgtgtaagtcaaag

SEQ ID NO: 7589 - DNA, 33 bp, Artificial Sequence
  Single strand DNA oligonucleotide
tctggtaccaaggtttcacaaaagtatcctgtc

SEQ ID NO: 7590 - DNA, 40 bp, Artificial Sequence
  Single strand DNA oligonucleotide
tttggtaccttatgcttacaactgaacaactgtttgtatc

SEQ ID NO: 7591 - DNA, 33 bp, Artificial Sequence
  Single strand DNA oligonucleotide
aaaggtaccaaagctaacatggcttacgaatac

SEQ ID NO: 7592 - DNA, 35 bp, Artificial Sequence
  Single strand DNA oligonucleotide
tttggtacctcattctcaatcgatatccaaggtgg

SEQ ID NO: 7593 - DNA, 31 bp, Artificial Sequence
  Single strand DNA oligonucleotide
aaagaattcatgaaacgcagagtattcgacc

SEQ ID NO: 7594 - DNA, 30 bp, Artificial Sequence
  Single strand DNA oligonucleotide
aaaggtacccagcttactgttaggcgttcg

SEQ ID NO: 7595 - DNA, 29 bp, Artificial Sequence
  Single strand DNA oligonucleotide
aaaggtaccgtatcggctactctggcagc

SEQ ID NO: 7596 - DNA, 30 bp, Artificial Sequence
  Single strand DNA oligonucleotide
aaaggtaccaaattgtgctcctgcaaacag

SEQ ID NO: 7597 - DNA, 31 bp, Artificial Sequence
  Single strand DNA oligonucleotide
aaaggtaccagtacttcatggagcccatctg

SEQ ID NO: 7598 - DNA, 31 bp, Artificial Sequence
  Single strand DNA oligonucleotide
aaaggtacctgaagtggttacaatcagctcg

SEQ ID NO: 7599 - DNA, 31 bp, Artificial Sequence
  Single strand DNA oligonucleotide
aaagaattcactagtgcggagtagaccgatg

SEQ ID NO: 7600 - DNA, 35 bp, Artificial Sequence
  Single strand DNA oligonucleotide
aaaggtaccctagctacagctagtgattgacggag

SEQ ID NO: 7601 - DNA, 31 bp, Artificial Sequence
  Single strand DNA oligonucleotide
aaagaattcgaagagtactccctccgtctcg

SEQ ID NO: 7602 - DNA, 31 bp, Artificial Sequence
  Single strand DNA oligonucleotide
aaaggtaccaaacagggagtgtacatggagg

SEQ ID NO: 7603 - DNA, 35 bp, Artificial Sequence
  Single strand DNA oligonucleotide
aaagaattcggttcattgaactgattagtggtacc

SEQ ID NO: 7604 - DNA, 31 bp, Artificial Sequence
  Single strand DNA oligonucleotide
tttggtacctcatcacatgaacctgcccaac

SEQ ID NO: 7605 - DNA, 31 bp, Artificial Sequence
  Single strand DNA oligonucleotide
aaaggatccccatgtgcttccatctgttatg

SEQ ID NO: 7606 - DNA, 31 bp, Artificial Sequence
  Single strand DNA oligonucleotide
aaaggtaccatgtgcagatcaacaacagctc

SEQ ID NO: 7607 - DNA, 31 bp, Artificial Sequence
  Single strand DNA oligonucleotide
aaaggtaccctaattccgatggttcgacaac

SEQ ID NO: 7608 - DNA, 31 bp, Artificial Sequence
  Single strand DNA oligonucleotide
aaagaattcaatttctgaatggtgtgccaag

SEQ ID NO: 7609 - DNA, 31 bp, Artificial Sequence
  Single strand DNA oligonucleotide
aaaggtacccagctctagtgcaacaccattc

SEQ ID NO: 7610 - DNA, 31 bp, Artificial Sequence
  Single strand DNA oligonucleotide
aaaggtaccaattccctgaggatttctggac

SEQ ID NO: 7611 - DNA, 31 bp, Artificial Sequence
  Single strand DNA oligonucleotide
aaaggtacccaggatcactagccacaacaac

SEQ ID NO: 7612 - DNA, 34 bp, Artificial Sequence
  Single strand DNA oligonucleotide
aaaaggcctagagctgattaaagagggttttctc

SEQ ID NO: 7613 - DNA, 31 bp, Artificial Sequence
  Single strand DNA oligonucleotide
aaaggtacccctttagtacatttgccgaacg

SEQ ID NO: 7614 - DNA, 28 bp, Artificial Sequence
  Single strand DNA oligonucleotide
tttaggcctaggcaagaccgtggaagag

SEQ ID NO: 7615 - DNA, 33 bp, Artificial Sequence
  Single strand DNA oligonucleotide
aaaaggccttcatactttgctgttcatcgtagc

SEQ ID NO: 7616 - DNA, 31 bp, Artificial Sequence
  Single strand DNA oligonucleotide
aaaaggccttagcaaccatcaactcgtaagc

SEQ ID NO: 7617 - DNA, 31 bp, Artificial Sequence
  Single strand DNA oligonucleotide
aaaggtaccggagactgatcatttcgactgg

SEQ ID NO: 7618 - DNA, 31 bp, Artificial Sequence
  Single strand DNA oligonucleotide
tttgaattctcacataccaccgaaggcaggt

SEQ ID NO: 7619 - DNA, 28 bp, Artificial Sequence
  Single strand DNA oligonucleotide
tttaggcctcatgagcacgtgcaacaac

SEQ ID NO: 7620 - DNA, 34 bp, Artificial Sequence
  Single strand DNA oligonucleotide
tttaggcctctattacagtggtgacacattcgtc

SEQ ID NO: 7621 - DNA, 31 bp, Artificial Sequence
  Single strand DNA oligonucleotide
aaaggtaccgatagcaatcgcatatgtccag

SEQ ID NO: 7622 - DNA, 34 bp, Artificial Sequence
  Single strand DNA oligonucleotide
aaaggtaccctatgtctgcctaatacacgacgac

SEQ ID NO: 7623 - DNA, 31 bp, Artificial Sequence
  Single strand DNA oligonucleotide
aaaggtaccatcaaagcaacaaaccagttcc

SEQ ID NO: 7624 - DNA, 31 bp, Artificial Sequence
  Single strand DNA oligonucleotide
aaaggtacctatcgctactggaccaagtgtg

SEQ ID NO: 7625 - DNA, 29 bp, Artificial Sequence
  Single strand DNA oligonucleotide
aaaggtaccatccagccagccactcctac

SEQ ID NO: 7626 - DNA, 37 bp, Artificial Sequence
  Single strand DNA oligonucleotide
tttaggccttcaagaaccaacatacctcagtcacctc

SEQ ID NO: 7627 - DNA, 34 bp, Artificial Sequence
  Single strand DNA oligonucleotide
aaagaattcctatgaaaggtcaaggaaagaatcg

SEQ ID NO: 7628 - DNA, 34 bp, Artificial Sequence
  Single strand DNA oligonucleotide
aaaggtaccgcctacaattgcagactatgctaag

SEQ ID NO: 7629 - DNA, 37 bp, Artificial Sequence
  Single strand DNA oligonucleotide
tttggtaccttaataggcttacagctgggtactcgct

SEQ ID NO: 7630 - DNA, 35 bp, Artificial Sequence
  Single strand DNA oligonucleotide
aaaggtaccctatgtaaactcttcgctcttgcatc

SEQ ID NO: 7631 - DNA, 33 bp, Artificial Sequence
  Single strand DNA oligonucleotide
aaaggatccctatgcattcactgagacgatctg

SEQ ID NO: 7632 - DNA, 34 bp, Artificial Sequence
  Single strand DNA oligonucleotide
aaaggtaccctagcaaatggaagattgatggtag

SEQ ID NO: 7633 - DNA, 31 bp, Artificial Sequence
  Single strand DNA oligonucleotide
aaaggtacccttccactccatcttggctatc

SEQ ID NO: 7634 - DNA, 27 bp, Artificial Sequence
  Single strand DNA oligonucleotide
aaaaggcctaatgcgcagctccgactc

SEQ ID NO: 7635 - DNA, 34 bp, Artificial Sequence
  Single strand DNA oligonucleotide
aaaggtaccaacatcctagacaaacgaggcttag

SEQ ID NO: 7636 - DNA, 32 bp, Artificial Sequence
  Single strand DNA oligonucleotide
aaaaggcctcatcattgatttcattgtcaacc

SEQ ID NO: 7637 - DNA, 35 bp, Artificial Sequence
  Single strand DNA oligonucleotide
aaagaattccctctagggtctagctacttcattcc

SEQ ID NO: 7638 - DNA, 31 bp, Artificial Sequence
  Single strand DNA oligonucleotide
aaaggtaccctttcgtcatcgaagaacaagc

SEQ ID NO: 7639 - DNA, 31 bp, Artificial Sequence
  Single strand DNA oligonucleotide
aaaggtaccaccacaaggttgtacaagggag

SEQ ID NO: 7640 - DNA, 35 bp, Artificial Sequence
  Single strand DNA oligonucleotide
tttggtacctcagactcaagcgttgatcatctcac

SEQ ID NO: 7641 - DNA, 33 bp, Artificial Sequence
  Single strand DNA oligonucleotide
tttggtacctcatcaggttgaaactttgctccc

SEQ ID NO: 7642 - DNA, 37 bp, Artificial Sequence
  Single strand DNA oligonucleotide
aaaggtaccctatttacataagaaactggggatttga

SEQ ID NO: 7643 - DNA, 31 bp, Artificial Sequence
  Single strand DNA oligonucleotide
aaaggtacccgcatggctacttagttgaacc

SEQ ID NO: 7644 - DNA, 31 bp, Artificial Sequence
  Single strand DNA oligonucleotide
aaagaattcaagaacccgagtgacatagctg

SEQ ID NO: 7645 - DNA, 31 bp, Artificial Sequence
  Single strand DNA oligonucleotide
aaaggtaccttcgtatccgacactcacaaac

SEQ ID NO: 7646 - DNA, 37 bp, Artificial Sequence
  Single strand DNA oligonucleotide
aaaggtaccctagaataaatctaagacaagccgaacc

SEQ ID NO: 7647 - DNA, 39 bp, Artificial Sequence
  Single strand DNA oligonucleotide
tttggtacctcatatgcttcaaaggaagacaagttttag

SEQ ID NO: 7648 - DNA, 31 bp, Artificial Sequence
  Single strand DNA oligonucleotide
aaaggtaccccattgtttgatctccagttcc

SEQ ID NO: 7649 - DNA, 32 bp, Artificial Sequence
  Single strand DNA oligonucleotide
aaaggtaccttaggtcccaaacttcatcattc

SEQ ID NO: 7650 - DNA, 35 bp, Artificial Sequence
  Single strand DNA oligonucleotide
aaagaattcctaaacgagagcaccattacaatcac

SEQ ID NO: 7651 - DNA, 34 bp, Artificial Sequence
  Single strand DNA oligonucleotide
tttgaattcctattacgtggctctccttagatcc

SEQ ID NO: 7652 - DNA, 36 bp, Artificial Sequence
  Single strand DNA oligonucleotide
aaaggtaccccaattaacaacatagtttcaagttcc

SEQ ID NO: 7653 - DNA, 30 bp, Artificial Sequence
  Single strand DNA oligonucleotide
aaagaattcatctgcaatcattcgtgaacc

SEQ ID NO: 7654 - DNA, 30 bp, Artificial Sequence
  Single strand DNA oligonucleotide
aaagaattcgtttgctcgggtacacacaac

SEQ ID NO: 7655 - DNA, 31 bp, Artificial Sequence
  Single strand DNA oligonucleotide
aaaggtaccactaaactctgcccaaaggtgc

SEQ ID NO: 7656 - DNA, 30 bp, Artificial Sequence
  Single strand DNA oligonucleotide
aaaggtaccggtatgatggacaacgaccag

SEQ ID NO: 7657 - DNA, 31 bp, Artificial Sequence
  Single strand DNA oligonucleotide
aaagaattccatcgaacataccatgtccaag

SEQ ID NO: 7658 - DNA, 31 bp, Artificial Sequence
  Single strand DNA oligonucleotide
aaaggtaccgaaacccagagtgctgctctac

SEQ ID NO: 7659 - DNA, 31 bp, Artificial Sequence
  Single strand DNA oligonucleotide
aaaggtacctaagaatcgaaggcttgagctg

SEQ ID NO: 7660 - DNA, 32 bp, Artificial Sequence
  Single strand DNA oligonucleotide
aaagaattcaactctgtttcatcaacacgacc

SEQ ID NO: 7661 - DNA, 32 bp, Artificial Sequence
  Single strand DNA oligonucleotide
aaaggtaccctataacatccctcccagtgtcc

SEQ ID NO: 7662 - DNA, 31 bp, Artificial Sequence
  Single strand DNA oligonucleotide
aaaggatccaactgagcgccttccaagtaac

SEQ ID NO: 7663 - DNA, 33 bp, Artificial Sequence
  Single strand DNA oligonucleotide
aaagaattcccggcagcatactatgtacagaac

SEQ ID NO: 7664 - DNA, 31 bp, Artificial Sequence
  Single strand DNA oligonucleotide
aaaggtaccaccacggtctcaattattctcg

SEQ ID NO: 7665 - DNA, 31 bp, Artificial Sequence
  Single strand DNA oligonucleotide
aaaggtaccacgtactacgccaagaggtgtc

SEQ ID NO: 7666 - DNA, 31 bp, Artificial Sequence
  Single strand DNA oligonucleotide
tttggtacctcagatggatcagtggcaggtg

SEQ ID NO: 7667 - DNA, 33 bp, Artificial Sequence
  Single strand DNA oligonucleotide
aaagaattcctaccaggaaaccgagaggagtag

SEQ ID NO: 7668 - DNA, 31 bp, Artificial Sequence
  Single strand DNA oligonucleotide
aaaggtaccgaagacttccaagctccaacag

SEQ ID NO: 7669 - DNA, 30 bp, Artificial Sequence
  Single strand DNA oligonucleotide
aaaggtaccggaccagatcactcgctacac

SEQ ID NO: 7670 - DNA, 31 bp, Artificial Sequence
  Single strand DNA oligonucleotide
aaaggtaccaaatacacgcctctaccacctg

SEQ ID NO: 7671 - DNA, 31 bp, Artificial Sequence
  Single strand DNA oligonucleotide
aaaggtaccagaagctcataacacaccgagc

SEQ ID NO: 7672 - DNA, 30 bp, Artificial Sequence
  Single strand DNA oligonucleotide
aaaggtaccgttccattgcttcagcatgtc

SEQ ID NO: 7673 - DNA, 34 bp, Artificial Sequence
  Single strand DNA oligonucleotide
aaaggatccctaaatctgacagtggaagcctttg

SEQ ID NO: 7674 - DNA, 37 bp, Artificial Sequence
  Single strand DNA oligonucleotide
tttggatcctcaaggtcttcacctatcaatttcttcc

SEQ ID NO: 7675 - DNA, 32 bp, Artificial Sequence
  Single strand DNA oligonucleotide
aaaggtacccccatcaactcatagtagcgaag

SEQ ID NO: 7676 - DNA, 34 bp, Artificial Sequence
  Single strand DNA oligonucleotide
tttggtacctcaagttcattcctcacaccgtgag

SEQ ID NO: 7677 - DNA, 30 bp, Artificial Sequence
  Single strand DNA oligonucleotide
aaaggtacccatcacaattcacaagccaag

SEQ ID NO: 7678 - DNA, 35 bp, Artificial Sequence
  Single strand DNA oligonucleotide
tttggtaccctattcctatggcgagcaaatatcac

SEQ ID NO: 7679 - DNA, 30 bp, Artificial Sequence
  Single strand DNA oligonucleotide
tttaggcctgtcagttggggtccttctagc

SEQ ID NO: 7680 - DNA, 31 bp, Artificial Sequence
  Single strand DNA oligonucleotide
aaaggatcctggtttcactataatcgccagc

SEQ ID NO: 7681 - DNA, 35 bp, Artificial Sequence
  Single strand DNA oligonucleotide
aaagaattcctacagaaaggatgtgaaagcaacag

SEQ ID NO: 7682 - DNA, 31 bp, Artificial Sequence
  Single strand DNA oligonucleotide
aaaggtaccacctattgcagcaactgaatcc

SEQ ID NO: 7683 - DNA, 31 bp, Artificial Sequence
  Single strand DNA oligonucleotide
aaaggtaccagattaaccacaggtccacagc

SEQ ID NO: 7684 - DNA, 31 bp, Artificial Sequence
  Single strand DNA oligonucleotide
aaaggtacccacaaatgcagctttacactgg

SEQ ID NO: 7685 - DNA, 31 bp, Artificial Sequence
  Single strand DNA oligonucleotide
aaaggtaccaacaaatcctgccatacagagc

SEQ ID NO: 7686 - DNA, 35 bp, Artificial Sequence
  Single strand DNA oligonucleotide
tttggtaccgactatgtagcaccagctatgctctg

SEQ ID NO: 7687 - DNA, 31 bp, Artificial Sequence
  Single strand DNA oligonucleotide
aaaaggccttagctgctgatccaacactctc

SEQ ID NO: 7688 - DNA, 31 bp, Artificial Sequence
  Single strand DNA oligonucleotide
aaaggtaccacctgtatcatcgcctaacacc

SEQ ID NO: 7689 - DNA, 31 bp, Artificial Sequence
  Single strand DNA oligonucleotide
aaagtcgacgggcgactatctctcctttagc

SEQ ID NO: 7690 - DNA, 31 bp, Artificial Sequence
  Single strand DNA oligonucleotide
aaaggtaccacctttacatgctgaatccgag

SEQ ID NO: 7691 - DNA, 31 bp, Artificial Sequence
  Single strand DNA oligonucleotide
aaaggtaccatcagtcagacgtccaaagcac

SEQ ID NO: 7692 - DNA, 33 bp, Artificial Sequence
  Single strand DNA oligonucleotide
tttggtacccggctactacagtacaaccacagg

SEQ ID NO: 7693 - DNA, 31 bp, Artificial Sequence
  Single strand DNA oligonucleotide
aaaggtaccaccaactacggcataacaaagg

SEQ ID NO: 7694 - DNA, 31 bp, Artificial Sequence
  Single strand DNA oligonucleotide
aaagaattcaatacacatggaacaaacggtg

SEQ ID NO: 7695 - DNA, 32 bp, Artificial Sequence
  Single strand DNA oligonucleotide
aaaggtaccgggagaaattaggttggatttcg

SEQ ID NO: 7696 - DNA, 31 bp, Artificial Sequence
  Single strand DNA oligonucleotide
aaaggtaccatgccaggcaatagagaatttg

SEQ ID NO: 7697 - DNA, 31 bp, Artificial Sequence
  Single strand DNA oligonucleotide
aaaggtaccacaagaatagtgacccaccctg

SEQ ID NO: 7698 - DNA, 31 bp, Artificial Sequence
  Single strand DNA oligonucleotide
aaaggtaccactctagtgacgaaccacggac

SEQ ID NO: 7699 - DNA, 34 bp, Artificial Sequence
  Single strand DNA oligonucleotide
aaaggtacctgttcctgcagatggatatttactc

SEQ ID NO: 7700 - DNA, 31 bp, Artificial Sequence
  Single strand DNA oligonucleotide
aaaggtaccagcaagctgatcgaaccatatc

SEQ ID NO: 7701 - DNA, 33 bp, Artificial Sequence
  Single strand DNA oligonucleotide
aaaggtaccctatttgaacaacgcaaacgattc

SEQ ID NO: 7702 - DNA, 37 bp, Artificial Sequence
  Single strand DNA oligonucleotide
tttaggccttcatacacatcaacgtgagatcttgaag

SEQ ID NO: 7703 - DNA, 31 bp, Artificial Sequence
  Single strand DNA oligonucleotide
aaagaattcctatcataaccggaccgtaagc

SEQ ID NO: 7704 - DNA, 31 bp, Artificial Sequence
  Single strand DNA oligonucleotide
aaaggtaccgcacacaatctccatgccttac

SEQ ID NO: 7705 - DNA, 31 bp, Artificial Sequence
  Single strand DNA oligonucleotide
aaagaattctggaatgcgagtaaacatcaac

SEQ ID NO: 7706 - DNA, 31 bp, Artificial Sequence
  Single strand DNA oligonucleotide
aaagaattcatccatcgtctcctgttcattc

SEQ ID NO: 7707 - DNA, 31 bp, Artificial Sequence
  Single strand DNA oligonucleotide
aaaggtacccgacaaggaacagactaggcac

SEQ ID NO: 7708 - DNA, 34 bp, Artificial Sequence
  Single strand DNA oligonucleotide
aaagaattcctacacgctacagctacatgctctc

SEQ ID NO: 7709 - DNA, 31 bp, Artificial Sequence
  Single strand DNA oligonucleotide
aaaaggcctgacactctctatgtgctcgacg

SEQ ID NO: 7710 - DNA, 30 bp, Artificial Sequence
  Single strand DNA oligonucleotide
tttggtacctcagcacgttgcttttgattc

SEQ ID NO: 7711 - DNA, 33 bp, Artificial Sequence
  Single strand DNA oligonucleotide
aaaggtaccgcacgttactggaaattgaatatg

SEQ ID NO: 7712 - DNA, 31 bp, Artificial Sequence
  Single strand DNA oligonucleotide
aaaggtaccatggtagcaaacagagccaaac

SEQ ID NO: 7713 - DNA, 36 bp, Artificial Sequence
  Single strand DNA oligonucleotide
aaaggtaccctaatccaattcaacaacagtttgaca

SEQ ID NO: 7714 - DNA, 30 bp, Artificial Sequence
  Single strand DNA oligonucleotide
aaaggtaccgatggaggaaacactgctagc

SEQ ID NO: 7715 - DNA, 38 bp, Artificial Sequence
  Single strand DNA oligonucleotide
tttggtaccttattataacttactcatcctgacgggtc

SEQ ID NO: 7716 - DNA, 30 bp, Artificial Sequence
  Single strand DNA oligonucleotide
tttaggcctagccagtcgttaacgctgaac

SEQ ID NO: 7717 - DNA, 31 bp, Artificial Sequence
  Single strand DNA oligonucleotide
aaagaattccttatggtttggtcggtttctc

SEQ ID NO: 7718 - DNA, 31 bp, Artificial Sequence
  Single strand DNA oligonucleotide
aaaggtacctgcatggtggattgattaacac

SEQ ID NO: 7719 - DNA, 31 bp, Artificial Sequence
  Single strand DNA oligonucleotide
aaaggtacctcccatagtagaatgcctttgg

SEQ ID NO: 7720 - DNA, 277 bp, Artificial Sequence
  NOS terminator
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 7721 - DNA, 2322 bp, Artificial Sequence
  AT 6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 7722 - DNA, 666 bp, Artificial Sequence
  35S pqfnc Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 7723 - DNA, 1127 bp, Artificial Sequence
  NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 7724 - DNA, 2318 bp, Artificial Sequence
  AT 6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 7725 - DNA, 1096 bp, Artificial Sequence
  RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 7726 - DNA, 1321 bp, Artificial Sequence
  rbcS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 7727 - DNA, 1358 bp, Artificial Sequence
  Ubi 1 Promoter
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 7728 - DNA, 781 bp, Artificial Sequence
  35S pJJ Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 7729 - DNA, 877 bp, Artificial Sequence
  35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc
